United States Patent 8,067,671 (METHODS FOR GENETIC CONTROL OF PLANT PEST INFESTATION AND COMPOSITIONS THEREOF) - sequence listing, part 56

SEQ ID NO: 168895 - protein, 152 aa, Heterodera glycines
  Coding regions on vcDNA: vcDNA=SeqID_95318; Strand=+; Position=39-494
MNSKMHRSFFHWTSLLMQGGILCAPIIVNLQRNKLNHDFKLRKMMSADLPNMPDENLLDLVEAEMLAKSNDRLYPFEKHHFGIKVKDDIESNTYGFFYCQNGVTFRFSSRLALNDVETIRRHYPNFLGLFKENLKSKWAKDLESVKENLRSA

SEQ ID NO: 168896 - protein, 129 aa, Heterodera glycines; identical to SEQ ID NO: 163892
  Coding regions on vcDNA: vcDNA=SeqID_95319; Strand=-; Position=8-397

SEQ ID NO: 168897 - protein, 490 aa, Heterodera glycines
  misc_feature (67)..(67): Xaa can be any naturally occurring amino acid
  Homolog annotation: Hit_ID=NP_506513.1; Match level="QueryCoverage =97%, HitCoverage=85%, E-value=1e-113, Identity=49%"; Hit description= TRNA Methylase (58.3 kD) (trm-1) [Caenorhabditis elegans] emb|CAB00881.1| Hypothetical protein ZC376.5 [
  Gene Ontology: Mol. function=tRNA (guanine-N2-)-methyltransferase activity; Cellular component=mitochondrion; Biological process=tRNA modification
  Coding regions on vcDNA: vcDNA=SeqID_95320; Strand=+; Position=39-1507
MDGAESVILQCATEKGNGVGPSVAADCEANKLAEVTEGLARITATAEGGETFYNRVQEFNRDLTSLXVVVLRAFAAEIPNEKEPKTEEEGPKAKQRKMDEGKAPEANAAQSQPRAFSVLDALSASGLRAIRFALEVPNVTRVVANDFSEKAFEAIRRNVQLNGVQDKVEAVFSDAIDLMMAHRKFGKRFHAVDLDPYGSASAFLDAAVQAVMDGGLLMVTCTDTAILCGNTPEACFNKYGSVPLRHKSCHELALRILLRAIDAHANRHKRYIVPLLSVSVDFYVRCFVRIRSGAAMAKDSVTKLANVNCCATCQSLDFQPLLKKSVSGPSVRFSTAHFQSELVRLFLGQSDASMDGRMVAKCAHCGGTAIHTGGPIWVAPTWDTEFVGKLLAILKGPNAGQLRLGTRERLEGLLTVLSEELPDVPLFYEHDQLMVVMKCPSPKMNVFRSALLNAGFRCSISHCNPRAVKTDAPTSFLWDVCREWAKRNGI

SEQ ID NO: 168898 - protein, 156 aa, Heterodera glycines; identical to SEQ ID NO: 163505
  Homolog annotation: Hit_ID=EAL27616.1; Match level="QueryCoverage =62%, HitCoverage=85%, E-value=3e-25, Identity=57%"; Hit description =GA11196-PA [Drosophila pseudoobscura]
  Coding regions on vcDNA: vcDNA=SeqID_95321; Strand=+; Position=78-548

SEQ ID NO: 168899 - protein, 82 aa, Heterodera glycines; identical to SEQ ID NO: 163504
  Coding regions on vcDNA: vcDNA=SeqID_95322; Strand=+; Position=51-299

SEQ ID NO: 168900 - protein, 53 aa, Heterodera glycines; identical to SEQ ID NO: 163461
  Coding regions on vcDNA: vcDNA=SeqID_95323; Strand=+; Position=44-205

SEQ ID NO: 168901 - protein, 220 aa, Heterodera glycines
  Homolog annotation: Hit_ID=NP_499340.1; Match level="QueryCoverage =93%, HitCoverage=77%, E-value=1e-60, Identity=52%"; Hit description =mitochondrial ribosomal protein L22 like (30.5 kD) (3L707) [Caenorhabditis elegans] emb|CAA21022.1| Hypot
  Coding regions on vcDNA: vcDNA=SeqID_95324; Strand=+; Position=2-661
RRLPLVPRIAPFSPIQRFEKQFPKIYYAPEWRLDESGKRMTRGVEEKYSPMNNYGVTPDKWEYMNKVVWPPNYVVPETGKPKPREVFHCIENIHTAPKKMHTVHQFALNMVVDEAIQQLRNHQKKPTFLLADLIEEAKERARKEFFIENPGKMFVAETFHIQSKIVKGARRHAHEKWHPMRYRYINLFVRLQEGDPPKSQKREPDADGWDKMDNYYAFLQ

SEQ ID NO: 168902 - protein, 206 aa, Heterodera glycines
  Homolog annotation: Hit_ID=AAG21338.1; Match level="QueryCoverage =40%, HitCoverage=100%, E-value=1e-44, Identity=100%"; Hit description=hypothetical esophageal gland cell secretory protein 9 [Heterodera glycines]
  Gene Ontology: Mol. function=protein binding; Cellular component =integral to plasma membrane; Biological process=cell wall organization and biogenesis
  Coding regions on vcDNA: vcDNA=SeqID_95325; Strand=+; Position=63-683
MNCSSAAMLMLLMTIFTVLSNVNEVAAEEHELVSRIKRNGYGYSSGYGGGCSACQSSCTTCGYTSYHTVPAAPAPPPPPPPPPPPAPVYSQSSYSSCSTCGGSSYSSYPSSSYSSYPASSSSYSSYPASSSSYSSYPASSSSYSSYPSYSSSSSCSTCGLSGYSNSWNNGGSSSNTWSSGGSSMSAGNGGGYGYGGGSCSVCGKRK

SEQ ID NO: 168903 - protein, 337 aa, Heterodera glycines
  Homolog annotation: Hit_ID=NP_504656.1; Match level="QueryCoverage =99%, HitCoverage=98%, E-value=1e-125, Identity=69%"; Hit description= malate dehydrogenase (35.8 kD) (5G996) [Caenorhabditis elegans] gb|AAD14720.1| Hypothetical protein F46E
  Gene Ontology: Mol. function=malic enzyme activity; Cellular component=mitochondrion
  Coding regions on vcDNA: vcDNA=SeqID_95326; Strand=+; Position=45-1058
MTSQPIRVLVTGAAGQIGYSLVLQIAKGDVFGKDQPIVLVLLDIPPLTEVLTGVHYELVDCALPNLFGVEAVTTEEAAFKDIDYAFLVGAMPRKEGMERKDLLAANVRIFKSQGEALAKFSKPTVKVLVVGNPANTNALICAKYAASKIPAKNFSAMTRLDHNRAMAQVAQKCADGTTVGMVKNVIIWGNHSSTQFPDIRHAKIAKGGSETLAYDAVKDTAWIQDQFIKTVQKRGAVIIEKRKLSSAMSASKAACDHMRDWFFVTPSDGRWVSMAVFFYGSHGIPEGLVFSFPRTIDAQKKWRVGEGLYLDDFAKQKIDITKKELLAERDEALAACK

SEQ ID NO: 168904 - protein, 139 aa, Heterodera glycines
  Homolog annotation: Hit_ID=T15903; Match level="QueryCoverage=100%, HitCoverage=16%, E-value=3e-70, Identity=89%"; Hit description =protein kinase C homolog - Caenorhabditis elegans
  Gene Ontology: Mol. function=protein serine/threonine kinase activity; Cellular component=membrane fraction; Biological process =protein amino acid phosphorylation
  Coding regions on vcDNA: vcDNA=SeqID_95327; Strand=+; Position=3-419
GLFYLHSKGIIYRDLKLDNVMLERDGHIKITDFGMCKEGIQGDTTTKTFCGTPDYIAPEIILYQPYGKSVDWWAYGVLLFEMLAGQPPFDGEDEDELFTAITEHNVSYPKSMSKESVLICKGFLSKAPSKRLGCSADGE

SEQ ID NO: 168905 - protein, 93 aa, Heterodera glycines
  misc_feature (70)..(70): Xaa can be any naturally occurring amino acid
  Coding regions on vcDNA: vcDNA=SeqID_95328; Strand=+; Position=3-284
SMEIDSHPSAAVQPEPAPIEHQQQNNTRILPKSKKWWKKALNIRPMANSSTKPRSSWERKMQKKGQPPPXPGRWKAKIRQTVAKTKGTPGPGG

SEQ ID NO: 168906 - protein, 241 aa, Heterodera glycines
  Homolog annotation: Hit_ID=CAE60169.1; Match level="QueryCoverage =94%, HitCoverage=72%, E-value=4e-72, Identity=63%"; Hit description =Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Coding regions on vcDNA: vcDNA=SeqID_95329; Strand=+; Position=58-780
MSEKDVPLAFSGPVKFVSNALAGGTAAVVTKTVIAPIERVKLLLQAQDASAHITADKRYKGIVDVLVRVPKEQGFLAFWRGNFPSIVRYFPSQALNFAFNDLYKGILSKNSSSKNGQFLGSFASGAAAGATSSLFTYWLDFARTRLALDIGRSRESREFTGLADLFAKIWRSDGLFGLYRGFSVSIWASIIYRACYFGFFDKAKAYASSDGKRPLSFLERWLIAQGVTMASGMLAYPLDTV

SEQ ID NO: 168907 - protein, 102 aa, Heterodera glycines; identical to SEQ ID NO: 163973
  Coding regions on vcDNA: vcDNA=SeqID_95330; Strand=+; Position=74-382

SEQ ID NO: 168908 - protein, 112 aa, Heterodera glycines; identical to SEQ ID NO: 162499
  Coding regions on vcDNA: vcDNA=SeqID_95331; Strand=+; Position=13-351

SEQ ID NO: 168909 - protein, 82 aa, Heterodera glycines; identical to SEQ ID NO: 163665
  Coding regions on vcDNA: vcDNA=SeqID_95332; Strand=+; Position=17-265

SEQ ID NO: 168910 - protein, 59 aa, Heterodera glycines
  Coding regions on vcDNA: vcDNA=SeqID_95333; Strand=+; Position=1-180
IYGVCLTALPGPLVPLKIDFFNPPPPPKPRSGLRSWLVSIGFVSLILRCLGRKFVRSEC

SEQ ID NO: 168911 - protein, 356 aa, Heterodera glycines
  misc_feature (204)..(204): Xaa can be any naturally occurring amino acid
  misc_feature (240)..(240): Xaa can be any naturally occurring amino acid
  Homolog annotation: Hit_ID=CAE74915.1; Match level="QueryCoverage =100%, HitCoverage=54%, E-value=1e-146, Identity=72%"; Hit description=Hypothetical protein CBG22795 [Caenorhabditis briggsae]
  Gene Ontology: Mol. function=succinate dehydrogenase (ubiquinone) activity; Cellular component=mitochondrial inner membrane; Biological process=tricarboxylic acid cycle
  Coding regions on vcDNA: vcDNA=SeqID_95334; Strand=+; Position=2-1072
RGEGGFLINNEGERFMERYAPVAKDLASRDVVSRSMTIEIMEGRGVGPLKDHIFLQLHHLPPEQLAQRLPGISETARIFSGVDVTKEPIPVLPTVHYNMGGTPTNYEGQVIRFSNDKGDQVVPGLWAAGQCAAHSVHGANRLGANSLLDLVIFGRACAISILSANTPGDSLPPLETDAGESSIANLDDLRNASGDVSTADLQLXITLRTMQKHAPCCSKRPPLLQEGIEKGRSLFGLQKXLRVSDRRLIKNSYLVETLELHNLLINALQTIVAAENRRESRGAHAREDFPVRVDEFDYTKPTEGQSKKKLEEHWRKHSIIYQNVENGAVTLEYRPVIDTTLDKSETDWVPPKIRSY

SEQ ID NO: 168912 - protein, 110 aa, Heterodera glycines; identical to SEQ ID NO: 164172
  Homolog annotation: Hit_ID=NP_498776.1; Match level="QueryCoverage =100%, HitCoverage=99%, E-value=5e-37, Identity=66%"; Hit description= heat shock protein (hsp-12.2) [Caenorhabditis elegans] gb|AAA27953.1| Heat shock protein protein 12.2 [C
  Gene Ontology: Mol. function=chaperone activity; Cellular component =cytoplasm; Biological process=muscle contraction
  Coding regions on vcDNA: vcDNA=SeqID_95335; Strand=+; Position=23-355

SEQ ID NO: 168913 - protein, 158 aa, Heterodera glycines
  Homolog annotation: Hit_ID=NP_872098.1; Match level="QueryCoverage =45%, HitCoverage=44%, E-value=3e-11, Identity=38%"; Hit description =putative prenylated protein (4O63) [Caenorhabditis elegans] emb|CAD56257.1| Hypothetical protein Y67H2A.4
  Coding regions on vcDNA: vcDNA=SeqID_95336; Strand=+; Position=35-508
MSYAFVRQPHKNSVCLMGWPTTNSVIIRQRHGAETEQARIYWPGSGLRTKSEIEEEFKCARDGKYPEENLEDWSITGKRSLTQKALFHYTDRRAGKGYSDFATTLYYGRPYIWPPVREINRWHFFICVTFALVILVDCKWFVSSFELFRPPKSEAATL

SEQ ID NO: 168914 - protein, 207 aa, Heterodera glycines
  misc_feature (73)..(73): Xaa can be any naturally occurring amino acid
  Homolog annotation: Hit_ID=CAE66990.1; Match level="QueryCoverage =93%, HitCoverage=92%, E-value=8e-37, Identity=38%"; Hit description =Hypothetical protein CBG12388 [Caenorhabditis briggsae]
  Coding regions on vcDNA: vcDNA=SeqID_95337; Strand=+; Position=13-634
MLSSSACCTLLAALISAAFFAAANPPTVKQCLCSEIQPCTQKYMNTWKACMEQCKGHLSGVGGNVDKLGHCMXATRHSSNCTIKCTQSHSQTACAKSAASAKQVPKRYPETLEIATISEINRMVNSMGIEGAMKGLMDAGKKMYGCTSKCMNSKAGNCEKSFKCGLDYPPDNVAVQEVKKCALNSGLNTANAQALCKCASAAGVKNL

SEQ ID NO: 168915 - protein, 218 aa, Heterodera glycines
  Homolog annotation: Hit_ID=CAE66990.1; Match level="QueryCoverage =94%, HitCoverage=97%, E-value=9e-37, Identity=35%"; Hit description =Hypothetical protein CBG12388 [Caenorhabditis briggsae]
  Coding regions on vcDNA: vcDNA=SeqID_95338; Strand=+; Position=10-666
MLSSSACCTLLAALISAAFFAMANAQTVKQCLCSEIQPCSEKYMNTWKTCMQQCKGHFSSVGGDVEKLGHCLDSNQALLQSTIRCTQSHGDESCAKSPAAVKQVPKRYPETLEIATISEINRMINGMGLEGAMKGLMDAGKKAFGCTRKCMNTKAGNCEKTLKCGLDFPPDNVAVQEVKRCALNSGLNTANAQALCKCASAAGVKNLTPAICAKVKVT

SEQ ID NO: 168916 - protein, 191 aa, Heterodera glycines
  Homolog annotation: Hit_ID=NP_492873.1; Match level="QueryCoverage =73%, HitCoverage=91%, E-value=3e-20, Identity=41%"; Hit description =n-acetylglucosaminyl-phosphatidylinositol de-N-acetylase precursor (1L760) [Caenorhabditis elegans] emb|C
  Gene Ontology: Mol. function=N-acetylglucosaminylphosphatidylinositol deacetylase activity; Cellular component=endoplasmic reticulum; Biological process=signal transduction
  Coding regions on vcDNA: vcDNA=SeqID_95339; Strand=+; Position=1-573
PDYAKLRNFPSLKGTKAGAPRGGGRSRTSGSPGLQEFGTRKAFKFFFTAFLVSLLSVALHFYFDNKTIFPAKFGERWLLLIAHPDDETMFFGPTLLFLSSIGVQLHLLCITSGNSEGLGTIRRNELYSSASVYGIQPKYISFVDPEERRFPDGFRDWNITSLSALIYSYIRRLKPDGLITFDEWGISGHPN

SEQ ID NO: 168917 - protein, 148 aa, Heterodera glycines; identical to SEQ ID NO: 162314
  Coding regions on vcDNA: vcDNA=SeqID_95340; Strand=+; Position=7-453

SEQ ID NO: 168918 - protein, 138 aa, Heterodera glycines
  Homolog annotation: Hit_ID=NP_508272.1; Match level="QueryCoverage =98%, HitCoverage=97%, E-value=1e-47, Identity=64%"; Hit description =spondyloepiphyseal dysplasia late (XC58) [Caenorhabditis elegans] gb|AAB52862.1| Hypothetical protein W05
  Gene Ontology: Cellular component=TRAPP; Biological process=ER to Golgi transport
  Coding regions on vcDNA: vcDNA=SeqID_95341; Strand=+; Position=3-419
SREYYFVIVGRQDQPLFEMDFPPKKREQQQETHHLLQFIAHAALDIVDEQTLRETQMYFKIVDKFNEWFVSAFVTASRIRFLMLHTQKNEDGIKQFFQEIYEMYIKFSMNPFYRQDTPIRSPSFEQKAAMYGRKFLGV

SEQ ID NO: 168919 - protein, 207 aa, Heterodera glycines; identical to SEQ ID NO: 163498
  Homolog annotation: Hit_ID=NP_505711.2; Match level="QueryCoverage =60%, HitCoverage=12%, E-value=2e-17, Identity=34%"; Hit description =related to yeast Vacuolar Protein Sorting factor (119.2 kD) (vps-54) [Caenorhabditis elegans] emb|CAA9733
  Coding regions on vcDNA: vcDNA=SeqID_95342; Strand=+; Position=3-623

SEQ ID NO: 168920 - protein, 155 aa, Heterodera glycines
  Homolog annotation: Hit_ID=NP_626733.1; Match level="QueryCoverage =94%, HitCoverage=42%, E-value=2e-17, Identity=42%"; Hit description =putative oxidoreductase [Streptomyces coelicolor A3(2)] emb|CAB69779.1| putative oxidoreductase [Streptom
  Gene Ontology: Mol. function=protein binding; Cellular component =mitochondrion; Biological process=induction of apoptosis
  Coding regions on vcDNA: vcDNA=SeqID_95343; Strand=+; Position=10-474
MASSAAGFAIVTGANTGLGLHFVKSLYASGTYSAIVLACRSEQRAKSAIEQICCGQSSPAENGNGTQTKLEFAKLDLTCNDSVRTFVSQLDERPYQKGSLRLLVNNAGIMGHPFQLVDGVEVHFASNHLGHFLLTNLLIKHNWLASDARILLVTS

SEQ ID NO: 168921 - protein, 95 aa, Heterodera glycines
  Coding regions on vcDNA: vcDNA=SeqID_95344; Strand=+; Position=1-288
LCRSSYQSLAHLCRNQIRVYSVEREGAGTASGIEHALKFNKAGAVHKKELKDYKCVEYLHQNNYSFYDKECELQQFRVVQPTNKLPDTEPKFKSS

SEQ ID NO: 168922 - protein, 207 aa, Heterodera glycines
  Homolog annotation: Hit_ID=CAE68811.1; Match level="QueryCoverage =79%, HitCoverage=58%, E-value=3e-24, Identity=36%"; Hit description =Hypothetical protein CBG14763 [Caenorhabditis briggsae]
  Coding regions on vcDNA: vcDNA=SeqID_95345; Strand=+; Position=36-656
MVDVPADFAVLLNSAPPISRIESNKMHWLRKRQQTNATALQRGIDQIGQLATESRGLKRPVTSFARFADSPDEQALYLLWEPLTSDQPTANGGPSSRIYGYLKVVRDRRLYLVDGEGRQFVTTPLCVLDFFIHQSVQHQGKGAQLFRAMLKAEGDLGAHRCAFDKPSDVFLHFLARHFGLERPLWQPNSFVVFPSFFEGIKPEKVSS

SEQ ID NO: 168923 - protein, 237 aa, Heterodera glycines
  misc_feature (51)..(51): Xaa can be any naturally occurring amino acid
  Homolog annotation: Hit_ID=YP_047926.1; Match level="QueryCoverage =96%, HitCoverage=97%, E-value=8e-34, Identity=35%"; Hit description =putative transcriptional activator (TenA family) [Acinetobacter sp. ADP1] emb|CAG70104.1| putative transc
  Gene Ontology: Mol. function=phosphomethylpyrimidine kinase activity; Biological process=thiamin biosynthesis
  Coding regions on vcDNA: vcDNA=SeqID_95346; Strand=+; Position=20-731
MEKSANNFSKILWTQNEHRFQQICALPFIREQKDGTLAEERYRHYIIQDTXSLEGLSSAIAVAASKATDHPKGHERAMLLLSHGIAILDTELDLHDGILRKLGLVSRSEVHMNYDQSPVCHHYVSFLAATASQQSLPVIVASMLPCYWLYREVAKWMLAERQKAGGTNTVTQYHEWIDMYCSEEYAEAVDEMLALADELSQEADQRTLAKMATVFERSFQLEWMFWKSAYQMCQWGI

SEQ ID NO: 168924 - protein, 426 aa, Heterodera glycines
  Homolog annotation: Hit_ID=CAE61696.1; Match level="QueryCoverage =96%, HitCoverage=86%, E-value=1e-174, Identity=71%"; Hit description= Hypothetical protein CBG05644 [Caenorhabditis briggsae]
  Gene Ontology: Mol. function=protein binding; Cellular component =cytoplasm; Biological process=protein amino acid phosphorylation
  Coding regions on vcDNA: vcDNA=SeqID_95347; Strand=+; Position=1-1336
VSLKAGGDLSVGCQWPGSKDEYELQDAIGVGATATVFKAFCKSKNEMCAIKSINLEKCQTSVDELSHEIQAMSLCSHPNVVNYYTSFVVGEELWVVMRLLNCGSMLDILKRKIKAIGKDQAAYGVLDEVIIATVLKEVLRGLEYFHNSGQIHRDIKAGNILLANDGTVQIADFGVSGWLAASGGDLSRQKVRHTFVGTPCWMAPEVMEQLATGTAPYHRYPPMKVLMLTLQNDPPSLETNADRKEQYKAYGKSFRTVIKDCLQKDPSKRPTASELLKYSFFKKAKDKSWLVHSLIENLGSAPSIPTIPKKVASGKLKKDKDGNWEFEYDTSDEENSSDPENATIQQSASGERPTVSRASSEGKGEEQMPPLQTLNLVLRVRNQQRELNDIKFDYSPNADSVDGIAHELVTAELIDGHDLVVVAANL

SEQ ID NO: 168925 - protein, 148 aa, Heterodera glycines
  Homolog annotation: Hit_ID=NP_495990.1; Match level="QueryCoverage =70%, HitCoverage=15%, E-value=5e-17, Identity=42%"; Hit description =tubulin-tyrosine ligase (76.8 kD) (2J631) [Caenorhabditis elegans] emb|CAA87783.1| Hypothetical protein D
  Coding regions on vcDNA: vcDNA=SeqID_95348; Strand=+; Position=36-479
MTHHLNFDQFLQVHEPQLLASGLPELFWKSLYKKISNQIFDAGKYFEVIIEESEPNETISSQVKAMSELKMDDPENVFLIDHAWTFRPNTARFALQQVDGLRKRLLDMFNIKAWYANKECLKDPFADDSADQQQKCADAVATHSADCE

SEQ ID NO: 168926 - protein, 144 aa, Heterodera glycines; identical to SEQ ID NO: 166624
  Homolog annotation: Hit_ID=CAE74062.1; Match level="QueryCoverage =68%, HitCoverage=49%, E-value=1e-15, Identity=43%"; Hit description =Hypothetical protein CBG21714 [Caenorhabditis briggsae]
  Coding regions on vcDNA: vcDNA=SeqID_95349; Strand=+; Position=70-501

SEQ ID NO: 168927 - protein, 155 aa, Heterodera glycines; identical to SEQ ID NO: 162219
  Homolog annotation: Hit_ID=CAE66022.1; Match level="QueryCoverage =68%, HitCoverage=49%, E-value=6e-14, Identity=41%"; Hit description =Hypothetical protein CBG11216 [Caenorhabditis briggsae]
  Coding regions on vcDNA: vcDNA=SeqID_95350; Strand=+; Position=23-490

SEQ ID NO: 168928 - protein, 107 aa, Heterodera glycines
  Homolog annotation: Hit_ID=CAE67912.1; Match level="QueryCoverage =63%, HitCoverage=79%, E-value=4e-11, Identity=47%"; Hit description =Hypothetical protein CBG13509 [Caenorhabditis briggsae]
  Coding regions on vcDNA: vcDNA=SeqID_95351; Strand=+; Position=62-385
MAEVKKEPIFTEVKKEPIFAAETPAAEPRRDSAVSTMPPDFDDVTAVIEGVLRETRDRFQAMADQIIHRIDEMTQRVDSLEKNITEMMASDSALVASTSGTVDEDNQ

SEQ ID NO: 168929 - protein, 134 aa, Heterodera glycines; identical to SEQ ID NO: 163457
  Coding regions on vcDNA: vcDNA=SeqID_95352; Strand=+; Position=34-438

SEQ ID NO: 168930 - protein, 151 aa, Heterodera glycines
  Homolog annotation: Hit_ID=CAE66008.1; Match level="QueryCoverage =80%, HitCoverage=52%, E-value=2e-38, Identity=63%"; Hit description =Hypothetical protein CBG11199 [Caenorhabditis briggsae]
  Coding regions on vcDNA: vcDNA=SeqID_95353; Strand=+; Position=46-498
MFVRCFILPFISLTFFVSFCTAMRRNPSDYDQSRVPSNLRIISWLLGVWRSEHDGKAMFPTIPKFTYGEEISIALSDTRMNGLPAFNYSAFAWSAHDQDELHSENGYITVSGGKVMLTTVMNNGFVTVEEGPAGGSRIRFKLVDIGRISFS

SEQ ID NO: 168931 - protein, 121 aa, Heterodera glycines; identical to SEQ ID NO: 163984
  Homolog annotation: Hit_ID=NP_497618.1; Match level="QueryCoverage =96%, HitCoverage=97%, E-value=9e-44, Identity=66%"; Hit description =cytochrome C oxidase (14.8 kD) (3D877Co) [Caenorhabditis elegans] gb|AAK29974.1| Hypothetical protein Y71
  Coding regions on vcDNA: vcDNA=SeqID_95354; Strand=+; Position=55-420

SEQ ID NO: 168932 - protein, 123 aa, Heterodera glycines; identical to SEQ ID NO: 163758
  Coding regions on vcDNA: vcDNA=SeqID_95355; Strand=+; Position=54-425

SEQ ID NO: 168933 - protein, 95 aa, Heterodera glycines; identical to SEQ ID NO: 163272
  Homolog annotation: Hit_ID=NP_500197.1; Match level="QueryCoverage =98%, HitCoverage=97%, E-value=3e-23, Identity=61%"; Hit description =protein translocation complex beta (8.6 kD) (4D152) [Caenorhabditis elegans] gb|AAK68450.1| Hypothetical
  Coding regions on vcDNA: vcDNA=SeqID_95356; Strand=+; Position=44-331

SEQ ID NO: 168934 - protein, 78 aa, Heterodera glycines; identical to SEQ ID NO: 166621
  Homolog annotation: Hit_ID=NP_493672.1; Match level="QueryCoverage =92%, HitCoverage=21%, E-value=2e-13, Identity=50%"; Hit description =mitochondrial ribosomal protein L28 (36.4 kD) (2A446) [Caenorhabditis elegans] gb|AAC26291.1| Hypothetica
  Gene Ontology: Biological process=positive regulation of growth rate
  Coding regions on vcDNA: vcDNA=SeqID_95357; Strand=+; Position=1-237

SEQ ID NO: 168935 - protein, 54 aa, Heterodera glycines
  Coding regions on vcDNA: vcDNA=SeqID_95358; Strand=+; Position=3-167
LELSECIPFDLFHQQLIFMLRSSLSKQQRNIFNALKSSAAVRNFLVDFYLNNVD

SEQ ID NO: 168936 - protein, 112 aa, Heterodera glycines; identical to SEQ ID NO: 166620
  Homolog annotation: Hit_ID=NP_496059.2; Match level="QueryCoverage =73%, HitCoverage=15%, E-value=3e-24, Identity=67%"; Hit description =UDP-glucuronosyltransferase (61.1 kD) (2J876) [Caenorhabditis elegans] emb|CAA85328.2| Hypothetical prote
  Coding regions on vcDNA: vcDNA=SeqID_95359; Strand=+; Position=1-339

SEQ ID NO: 168937 - protein, 132 aa, Heterodera glycines
  Homolog annotation: Hit_ID=NP_501109.1; Match level="QueryCoverage =68%, HitCoverage=30%, E-value=1e-22, Identity=60%"; Hit description =putative protein, with a coiled coil-4 domain, of bilaterial origin (4H869) [Caenorhabditis elegans]
  Coding regions on vcDNA: vcDNA=SeqID_95360; Strand=+; Position=24-419
MRYLLRIRNYNFLTKIGKSSVVQSQESPPSLLTDSKPFKKVLNSAVQYYEECIGLVEVHKARDEVNRCENNLFLAQQARREKQGEIKSLQNRLKDIHSELDRTQRGEDRYLHLLTEEHAAIKSERELLSSFE

SEQ ID NO: 168938 - protein, 169 aa, Heterodera glycines
  Coding regions on vcDNA: vcDNA=SeqID_95361; Strand=+; Position=2-508
QISWCHGVSTDLMQIDEQQQQQMAAANECCFIYPFPASGLSSRQLMRVLSAWLMPSFSADEEGPSMNVPSCFSDIDSSFECASFSVPMVFSHDEWFVQCVPALCEQLDKLLLLSQHQREEEGNSCLQQRRNTDDDGECHVRRVLRHLLALTTRIPMRTRPRTEMGLFIA

SEQ ID NO: 168939 - protein, 302 aa, Heterodera glycines; identical to SEQ ID NO: 163814
  Homolog annotation: Hit_ID=NP_507876.1; Match level="QueryCoverage =94%, HitCoverage=91%, E-value=2e-67, Identity=46%"; Hit description =histidine triad HIT-5 (5U558) [Caenorhabditis elegans] gb|AAL86013.1| heat shock-like protein [Caenorhabd
  Gene Ontology: Mol. function=hydrolase activity, acting on acid anhydrides, in phosphorus-containing anhydrides; Cellular component =nucleus; Biological process=rRNA processing
  Coding regions on vcDNA: vcDNA=SeqID_95362; Strand=+; Position=24-932

SEQ ID NO: 168940 - protein, 81 aa, Heterodera glycines; identical to SEQ ID NO: 163193
  Coding regions on vcDNA: vcDNA=SeqID_95363; Strand=-; Position=2-247

SEQ ID NO: 168941 - protein, 158 aa, Heterodera glycines
  Homolog annotation: Hit_ID=NP_871701.1; Match level="QueryCoverage =99%, HitCoverage=70%, E-value=1e-24, Identity=41%"; Hit description =RanBP1 domain containing protein, Nuclear Pore complex Protein NPP-9 (95.6 kD) (npp-9) [Caenorhabditis el
  Gene Ontology: Mol. function=RAN protein binding; Cellular component =cytoplasm; Biological process=embryogenesis and morphogenesis
  Coding regions on vcDNA: vcDNA=SeqID_95364; Strand=+; Position=1-474
GSTTANTRTTISSADVSKAGKVTDKGGDSDDEAAEEFVPTGTFKPIVPLPSKVDVKSGEENEEVLFSARCKLFRYDPMDKKNKERGIGELKLLHNKETGRYRCVIRSDDQLCKLFANFPVLATMISRITGQKPNVRTLQCRDFSESSEGIDEVFLLKF

SEQ ID NO: 168942 - protein, 423 aa, Heterodera glycines
  Homolog annotation: Hit_ID=CAE71032.1; Match level="QueryCoverage =98%, HitCoverage=98%, E-value=1e-132, Identity=54%"; Hit description= Hypothetical protein CBG17873 [Caenorhabditis briggsae]
  Coding regions on vcDNA: vcDNA=SeqID_95365; Strand=+; Position=16-1287
MSTDRYDIVLYGASGFTGQHVLESFVKNGHLDQFNFAVAGRSEKKLKQTLEDIEFITGKVLTKIPIIIADSSDAQQLAEMAKQAKVIVNVVGPYRLYGEAVVKAAVENGASHVDISGEPAWIEAMQMKYSEKAKEQGVFIVSACGWDSVPCDLGMNYLKQYFKGTLSHAETFAHIQIGEAGYSFNAGTYQTLILGLWQAKNDDLGKIRRSIMPEKMEKTKWRPPKRGMFWWNDSLDAYCLPFMGADKSIVQRSQYFDNIADKTYPASLETYILVKSWFWAVALMMWLTIFYFAVKFDFTRGILQKYPGICSGYLFKETGPTRVQAQQASFTYWFFGWGWEQSSPQPDEAPTKRMVVRCDGPDAGYIGTAGCILSCALTILKERSAMPSEGGVFTTAAAFKNTNIYETLSSFGVTFRVDSSVKV

SEQ ID NO: 168943 - protein, 172 aa, Heterodera glycines; identical to SEQ ID NO: 163488
  Coding regions on vcDNA: vcDNA=SeqID_95366; Strand=+; Position=2-520

SEQ ID NO: 168944 - protein, 143 aa, Heterodera glycines
  Coding regions on vcDNA: vcDNA=SeqID_95367; Strand=+; Position=4-435
SKMRSICFCHFSAFSFSRQFFGGCHRSFSSPMTPLFLSFSLLLIYSQFASPTNAFILQELPLYRNVRNQRHATPPIGPSKPSIDYGIRRSTVSMPLVIRIEDGMPTIFVRPSRAFNFHRLNRLQEFWHRNEALRRLTQTGNRP

SEQ ID NO: 168945 - protein, 148 aa, Heterodera glycines
  Coding regions on vcDNA: vcDNA=SeqID_95368; Strand=-; Position=190-636
MVQFDQSFQVSLRLWASSEFGSQGSHKTRQPFALPYAVTHFHALAVPKTTGVQCSKNGTDEQKLIAINSLQKVLAATAVGKCEHQMFQRGETLASKFEDYLARVILNNCYAKFGHNAINTHRKQQFGSIGILNKEVSVMFKEFGGFTQ

SEQ ID NO: 168946 - protein, 142 aa, Heterodera glycines; identical to SEQ ID NO: 163836
  Homolog annotation: Hit_ID=CAE61811.1; Match level="QueryCoverage =78%, HitCoverage=87%, E-value=7e-09, Identity=32%"; Hit description =Hypothetical protein CBG05778 [Caenorhabditis briggsae]
  Coding regions on vcDNA: vcDNA=SeqID_95369; Strand=+; Position=53-481

SEQ ID NO: 168947 - protein, 156 aa, Heterodera glycines
  Homolog annotation: Hit_ID=NP_502658.1; Match level="QueryCoverage =88%, HitCoverage=90%, E-value=3e-59, Identity=80%"; Hit description =IscU (16.5 kD) (4O549) [Caenorhabditis elegans] emb|CAA16379.1| Hypothetical protein Y45F10D.4 [Caenorhab
  Gene Ontology: Cellular component=mitochondrion; Biological process =iron ion homeostasis
  Coding regions on vcDNA: vcDNA=SeqID_95370; Strand=+; Position=2-472
SFSLTRLFPTLVFHRHGNIQLLQIAAYHEKVIDHYENPRNVGSLDKNDPSVGTGIVGAPACGDVMKLQIMVDGNGQIIDAKFKTFGCGSAIASSSLATEWIKGQNLEYARKIKNQQIAKELSLPPVKLHCSMLAQDAIQAALSDYQKKQEARNEKT

SEQ ID NO: 168948 - protein, 58 aa, Heterodera glycines; identical to SEQ ID NO: 166611
  Coding regions on vcDNA: vcDNA=SeqID_95371; Strand=-; Position=2-175

SEQ ID NO: 168949 - protein, 106 aa, Heterodera glycines; identical to SEQ ID NO: 164060
  Coding regions on vcDNA: vcDNA=SeqID_95372; Strand=+; Position=23-343

SEQ ID NO: 168950 - protein, 159 aa, Heterodera glycines
  Coding regions on vcDNA: vcDNA=SeqID_95373; Strand=+; Position=3-479
FILLQHLNPQKMLSLIVIVCFFGIVPNLSKPIKLRNHSPMNVLFMAWPEARYPLELPFHRVDCFSEMERRHIVPQVITYRLENIKKLRNGICLVRIPTRSRVTVTQMNTNNVKSYVKFIAGSTQLSMPLHTDHIHSGQHEKFGPWHMPCRYAYIVFRSR

SEQ ID NO: 168951 - protein, 231 aa, Heterodera glycines
  Homolog annotation: Hit_ID=NP_505750.1; Match level="QueryCoverage =98%, HitCoverage=99%, E-value=3e-77, Identity=62%"; Hit description =proteasome Alpha Subunit (25.3 kD) (pas-2) [Caenorhabditis elegans] emb|CAA98441.1| Hypothetical protein
  Gene Ontology: Mol. function=endopeptidase activity; Cellular component=26S proteasome; Biological process=proteolysis and peptidolysis
  Coding regions on vcDNA: vcDNA=SeqID_95374; Strand=+; Position=45-737
MSTERYSFSLTTFSPSGKLMQIEYALNAVKGSAPSVGTRAKDCVVFATENKHSVLTQPVSKISKLSDHIACVYSGMGPDAQLLVKKARKIAMDYQVLYGYEIPVPQLVSRVAAVMQEYTQSGGVRPFGVSLLIGGWDSEKGALLFQADPAGSYFGWKSTAIGKNDQLAKKLLEKRYNEDIEKVDAIHMALLAMRETYDVAMTEDNVELAVCTKDCFERMNQEALREQIQPL

SEQ ID NO: 168952 - protein, 172 aa, Heterodera glycines
  Coding regions on vcDNA: vcDNA=SeqID_95375; Strand=-; Position=267-785
YWNDSSEEKRRRSGGNWTTDERSIFHGPFEVPLQNSADFCDFRPKCHRIIGSSPQNSVDGPQFVLLSHFLPLRFPWVQSHFWTVRCQNLVEAPKLKGQVVPFSFPAKAQRESVFRRLWPFRCFSLCLKRSLLTTVRLPLAFSSHKAFILLPRPHSLFRFLQLRCFARVAFQH

SEQ ID NO: 168953 - protein, 140 aa, Heterodera glycines
  Coding regions on vcDNA: vcDNA=SeqID_95376; Strand=-; Position=213-635
FFVVANWHRQFPAFFQLRFHKSIPRGQCHRLHLLAKVPSRQGPVRENRNNDHVARHHVIKGGLANHLFLRRSLARVNGVFLLLDFDFAFDIPTLQISDFKLFAGELTAGQLVFSPIETFQCTRPIFVEFKSCLFVFAQLQ

SEQ ID NO: 168954 - protein, 162 aa, Heterodera glycines
  Homolog annotation: Hit_ID=CAE64837.1; Match level="QueryCoverage =100%, HitCoverage=33%, E-value=9e-38, Identity=46%"; Hit description= Hypothetical protein CBG09633 [Caenorhabditis briggsae]
  Gene Ontology: Mol. function=protein phosphatase type 2C activity; Biological process=cell cycle
  Coding regions on vcDNA: vcDNA=SeqID_95377; Strand=+; Position=48-533
MGAFLDKPKTEKTNDAGVGRDYKYVVASMQGWRIDMEDAHHVQITIRKESPFEEWSFFAVFDGHAGNKVAFHSAQNLLQTLLNTAEFQAVKEELKTNGPKITEKAKSLIQDGIRMGFLELDSSLGELQGGGERERNGTTAICAILTPDYIFFANLGDSRGLL

SEQ ID NO: 168955 - protein, 206 aa, Heterodera glycines; identical to SEQ ID NO: 162305
  Homolog annotation: Hit_ID=CAE62925.1; Match level="QueryCoverage =87%, HitCoverage=44%, E-value=1e-59, Identity=56%"; Hit description =Hypothetical protein CBG07125 [Caenorhabditis briggsae]
  Gene Ontology: Mol. function=acyl-CoA dehydrogenase activity; Cellular component=mitochondrial matrix; Biological process=lipid metabolism
  Coding regions on vcDNA: vcDNA=SeqID_95378; Strand=+; Position=21-638

SEQ ID NO: 168956 - protein, 212 aa, Heterodera glycines
  Homolog annotation: Hit_ID=NP_502269.1; Match level="QueryCoverage =94%, HitCoverage=54%, E-value=8e-85, Identity=72%"; Hit description =zinc-containing alcohol dehydrogenase superfamily (40.2 kD) (4M724) [Caenorhabditis elegans] emb|CAA98080
  Coding regions on vcDNA: vcDNA=SeqID_95379; Strand=+; Position=47-682
MAQSQNGGVKNRRISLGSPKDLKEVHFFEEDEVPDVPLNGARVKVCYAGVCLTDKEISNTKQARITHGVKDTSLFPGYEVSGVIDEFGPNATPVEYNLKVGDKVIVWPTEEMCQNGYADFVAVPNLSLLVKIPDTLSMHVASILPAGATWALSAIVHARPVVEAIASTKGCCNILIVGAGGLGLWILTLAKHFLTAGQENRIKLIDAHSKEN

SEQ ID NO: 168957 - protein, 266 aa, Heterodera glycines; identical to SEQ ID NO: 163374
  Homolog annotation: Hit_ID=NP_491127.1; Match level="QueryCoverage =98%, HitCoverage=93%, E-value=8e-66, Identity=47%"; Hit description =thioredoxin-like protein (31.1 kD) (1D801) [Caenorhabditis elegans] gb|AAF60759.1| Hypothetical protein Y
  Gene Ontology: Mol. function=thiol-disulfide exchange intermediate activity; Cellular component=mitochondrion; Biological process =signal transduction
  Coding regions on vcDNA: vcDNA=SeqID_95380; Strand=+; Position=28-825

SEQ ID NO: 168958 - protein, 81 aa, Heterodera glycines
  Coding regions on vcDNA: vcDNA=SeqID_95381; Strand=+; Position=1-243
VNVTTNSNQISVYAASKFRVDINVSTRDESHLNNKYEILMEINTTDGGKQTILLDSKALVFLHDQLDALTRTFPKCYVCVD

SEQ ID NO: 168959 - protein, 151 aa, Heterodera glycines
  Coding regions on vcDNA: vcDNA=SeqID_95382; Strand=+; Position=2-454
NFLFQKEKTIIPMKDENAHFTPQQISKLLNLHIKSHKCLDVKCQTERQQLLSTIEKLARNFYDIYKMFEKQKREMSRISNLYKDFCIQFGLPVKIDLVKQQEISQIDKVANMIYQHFIKIREVNKKSKVHPNFDENLQSSGLTSINGQCKK

SEQ ID NO: 168960 - protein, 291 aa, Heterodera glycines
  misc_feature (62)..(62): Xaa can be any naturally occurring amino acid
  misc_feature (69)..(69): Xaa can be any naturally occurring amino acid
  Homolog annotation: Hit_ID=NP_498060.2; Match level="QueryCoverage =98%, HitCoverage=55%, E-value=4e-18, Identity=23%"; Hit description =putative protein of bilaterial origin (57.3 kD) (3G91) [Caenorhabditis elegans] gb|AAK21454.2| Hypothetic
  Coding regions on vcDNA: vcDNA=SeqID_95383; Strand=+; Position=1-877
QLAVHLLVQYSTMLDITARAFQRPFAIAFLMPSQPTAKNVEAFQQAAAELLMPIIACNKRYXIRFCVKXMLMLSERDQQNVQSYYSTSGNAQQIVIVSNKLKSVVQKTNAWFERVSDQLCESDGSADECFCECAGPEEFRQFVVLLAQKHSSCALLNLMELAPCKDVKLKHSIQEAYLRLTDTEVAKGLLFCGQTAVVRSTFGANSELPRHETEDPNRTEEECIPLVVARESTLKTLSYRLLRCVYPLLTGERIVILASKQRVSTGVDLLNKLNSMRICRRPLWRKMEFRF

SEQ ID NO: 168961 - protein, 207 aa, Heterodera glycines
  Homolog annotation: Hit_ID=CAE59555.1; Match level="QueryCoverage =97%, HitCoverage=97%, E-value=4e-17, Identity=29%"; Hit description =Hypothetical protein CBG02952 [Caenorhabditis briggsae]
  Gene Ontology: Cellular component=cytoplasm
  Coding regions on vcDNA: vcDNA=SeqID_95384; Strand=+; Position=75-698
MASQPIKAVLFDLGGVVVEYSDRNAYLNRLKIIQSNAKFVDLFEQFECGLLTIYEIEPEFLKTVMGNKSGDDLIKAANPTNLMKTKNPFVENAIRSLRSSGKYLVGLLTNNGFWVRDRSESKLIIDTSDFDFVIESCKIGARKPNADFYEMALLKMGLSAAECVFIDDLEENCKGAEAVGIRSIWLKDDDYKTAIEQLEEIIGEKLL

SEQ ID NO: 168962 - protein, 174 aa, Heterodera glycines
  Coding regions on vcDNA: vcDNA=SeqID_95385; Strand=+; Position=8-532
MLLSPPLLFVLSLCSLCAFGHKTPNASDGPAMPELPKALQKLSDAERNCLFTIYTMSKLFENKKVQKTLAKQLKSCDSKDTSEPDIWKSREKSNGWCEVNLERIDSEYGPVIMHAHGSIASINGARLFVKSTSGGIWIAIYQPECLKEKDESKKSEEGVVSNTLDRVRRWVLLK

SEQ ID NO: 168963 - protein, 156 aa, Heterodera glycines
  Homolog annotation: Hit_ID=CAE61563.1; Match level="QueryCoverage =86%, HitCoverage=42%, E-value=2e-14, Identity=36%"; Hit description =Hypothetical protein CBG05472 [Caenorhabditis briggsae]
  Coding regions on vcDNA: vcDNA=SeqID_95386; Strand=+; Position=12-479
MTSKIESTIASSFRKFLFWFRYDGSKFPAMAKGSDSRNGPSVMQVVESCLQKLFATENSDQIKTFAISRTDAKVHAIRSPILIGLPVACDWFSQSELARTEFLLCFNDQIRNNGFTNAIELLHVDPVAMGFHPCFHVSYRRYIYRLRVISTEQSLN

SEQ ID NO: 168964 - protein, 56 aa, Heterodera glycines
  misc_feature (5)..(5): Xaa can be any naturally occurring amino acid
  misc_feature (7)..(7): Xaa can be any naturally occurring amino acid
  Coding regions on vcDNA: vcDNA=SeqID_95387; Strand=+; Position=1-168
GKLHXRXWRPLLRTSGSPGLQESGTRQGPNLHFVSNIDGTHLAQVLKKVEPKTVLF

SEQ ID NO: 168965 - protein, 125 aa, Heterodera glycines; identical to SEQ ID NO: 162260
  Homolog annotation: Hit_ID=CAE75099.1; Match level="QueryCoverage =92%, HitCoverage=93%, E-value=3e-28, Identity=52%"; Hit description =Hypothetical protein CBG23021 [Caenorhabditis briggsae]
  Coding regions on vcDNA: vcDNA=SeqID_95388; Strand=+; Position=9-386

SEQ ID NO: 168966 - protein, 94 aa, Heterodera glycines
  misc_feature (94)..(94): Xaa can be any naturally occurring amino acid
  Coding regions on vcDNA: vcDNA=SeqID_95389; Strand=+; Position=3-284
HLSGTVWHRKGITCPSQGKFGHLRFLRQALLLRDALSVPSVPSVLKVPFDVKHNELEMILLFYFTGLFHFSFLISKQFFLICKFFIIYINFHLX

SEQ ID NO: 168967 - protein, 152 aa, Heterodera glycines; identical to SEQ ID NO: 166605
  Homolog annotation: Hit_ID=CAA70694.1; Match level="QueryCoverage =100%, HitCoverage=43%, E-value=1e-87, Identity=99%"; Hit description= cathepsin S-like cysteine proteinase [Heterodera glycines]
  Gene Ontology: Mol. function=cathepsin S activity; Cellular component= lysosome; Biological process=proteolysis and peptidolysis
  Coding regions on vcDNA: vcDNA=SeqID_95390; Strand=+; Position=3-461

SEQ ID NO: 168968 - protein, 155 aa, Heterodera glycines
  Coding regions on vcDNA: vcDNA=SeqID_95391; Strand=+; Position=27-494
MFSQLFLFLIFLAFSAESAPRGEKKKDTPKDRYSLCRKGGVPIAKLNDQINGKDFDKLFAPLFPHPLLISNLLSLEGLKCPDKIAPFLKKCDAKKDGEINLREFKCFVKSLLASYLVDEDRNKCITEEELESFYKECGLKEMEEEMMGDGSVRKE

SEQ ID NO: 168969 - protein, 271 aa, Heterodera glycines
  misc_feature (148)..(148): Xaa can be any naturally occurring amino acid
  Homolog annotation: Hit_ID=CAE75173.1; Match level="QueryCoverage =90%, HitCoverage=67%, E-value=1e-34, Identity=32%"; Hit description =Hypothetical protein CBG23110 [Caenorhabditis briggsae]
  Coding regions on vcDNA: vcDNA=SeqID_95392; Strand=+; Position=51-864
MIFRLGNFRHFPVNFCKLCIARFTVAFSRRIFRDHFSLFLRSKRSLLFGASLVGVSFGSNVTLEDEYKRIKTECKECDPFSPPPTDEGWTLFWCNKSLAVYRRRFVANGGNCVFEYRCIGTYEDISPNDFVTVQEDISCRLKWDKNVXALDELDFDYNTGTQVIRWESKYPFPLWPRLYIFARRQFVDRPRKQIYILSRALSSDNFPDPSQTTVRVECYESILIVRAHDSLDKKGLDFVLSYYDDTRSSIPQKIYQYGINVIGPSFIEDVH

SEQ ID NO: 168970 - protein, 319 aa, Heterodera glycines
  Homolog annotation: Hit_ID=NP_508928.2; Match level="QueryCoverage =98%, HitCoverage=41%, E-value=5e-34, Identity=34%"; Hit description =drosophila Discs Large homolog (107.0 kD) (dlg-1) [Caenorhabditis elegans] gb|AAK39197.2| Drosophila disc
  Gene Ontology: Mol. function=protein C-terminus binding; Cellular component=cytoplasm; Biological process=learning
  Coding regions on vcDNA: vcDNA=SeqID_95393; Strand=+; Position=67-1023
MAVPSISPLGRPHPPPPPRSPSRPSSKHSFAGDHGSFLQTSPINRIVDEEGQEWEVEEVQLDVSKTGLGFSISGGCDREPDLMYNDRYIRVTDISKGGAVETDRRIRIGDVILFVNDWETANREHDFAVQALKNAGTFVRLLVKRLKYPPLQKSLSQSHLSEPIASGTFQRSLSGGAADSRTLPLQPPVRSQSLHHLPMNAVATSPNVVTAMGTLPRRANVQQQFATPLNDPGRQPRWVVIRKGEMGFGFNIVGGEDGEPVYITRVAPGGAADQTGNIRMGDVLLRVNDVDLSMATHGEAAVALKAIPQGAQVKLLLQF

SEQ ID NO: 168971 - protein, 148 aa, Heterodera glycines
  Homolog annotation: Hit_ID=CAE67479.1; Match level="QueryCoverage =89%, HitCoverage=14%, E-value=4e-41, Identity=58%"; Hit description =Hypothetical protein CBG12983 [Caenorhabditis briggsae]
  Coding regions on vcDNA: vcDNA=SeqID_95394; Strand=+; Position=3-446
EHTFLQGAGQPDCSHTSDEYCQLPYYTAIHELFPPERSRWVPLPTQPPIASPLSVRLVQRQHLPGNQLNLTIAIQGGTDKLSLHITPLNGFQLRHWSLTPFDPATFGIRKTYFVFMTYGFESPGERLVWILLENNERSVSATDEVPSL

SEQ ID NO: 168972 - protein, 166 aa, Heterodera glycines
  Homolog annotation: Hit_ID=AAH75306.1; Match level="QueryCoverage =71%, HitCoverage=27%, E-value=8e-48, Identity=65%"; Hit description =D4, zinc and double PHD fingers family 2 [Xenopus tropicalis] ref|NP_ 001005717.1| D4, zinc and double PHD
  Gene Ontology: Mol. function=DNA binding; Cellular component=nucleus; Biological process=induction of apoptosis by extracellular signals
  Coding regions on vcDNA: vcDNA=SeqID_95395; Strand=+; Position=26-526
DEWEGCACPSQSPGTHSFDRNCQFCFPTVISPKVQVSEYCDFCLGTNLQNAEGEAEPLISCHDCGRSGHPTCLKFTKNMLVSTKRYGWQCIECKSCAICGTSENDDQLLFCDDCDRGFHLYCLKPPLKEAPETDWSCHLCVKEFGAEASIAKATKSTEDGTSSPAK

SEQ ID NO: 168973 - protein, 192 aa, Heterodera glycines
  Homolog annotation: Hit_ID=NP_493928.1; Match level="QueryCoverage =97%, HitCoverage=26%, E-value=9e-63, Identity=66%"; Hit description =Rap1GAP family member (83.9 kD) (2B519) [Caenorhabditis elegans] gb|AAK71368.1| Hypothetical protein F53A
  Gene Ontology: Mol. function=Rap GTPase activator activity; Cellular component=nucleus; Biological process=signal transduction
  Coding regions on vcDNA: vcDNA=SeqID_95396; Strand=+; Position=3-578
SSNCAALDEFLSIIGHRVQLRHFAGYRGGLDTVHGQSGTEVRWGRVGRAYGTVCIGDAQQLQRKRHIGNDIVAIVFQEQNTPFCPDMIASNFLHAYLVVHPIEPGTDRTRYRVSMTARDDVPFFGPTLPRSSIIWKCQLRDFLLTKLINAENAAYKAEKFAKLAERTRASLLDGLYSNLKERAQFYGMAFLD

SEQ ID NO: 168974 - protein, 54 aa, Heterodera glycines
  Homolog annotation: Hit_ID=CAE59762.1; Match level="QueryCoverage =98%, HitCoverage=12%, E-value=1e-20, Identity=88%"; Hit description =Hypothetical protein CBG03214 [Caenorhabditis briggsae]
  Gene Ontology: Mol. function=phosphopyruvate hydratase activity; Cellular component=soluble fraction; Biological process =gluconeogenesis
  Coding regions on vcDNA: vcDNA=SeqID_95397; Strand=+; Position=3-167
FIADLVVGLATGQIKTGAPCRSERLAKYNRIMRIEEELGTDAVYAGKSFRNPQN

SEQ ID NO: 168975 - protein, 102 aa, Heterodera glycines
  Coding regions on vcDNA: vcDNA=SeqID_95398; Strand=-; Position=44-352
TLYIKINKLTKKNSHLNLKWKMIFRAHQQLKICDSRRGGRTFANKERPTVTPMRKFVQASAADPSSNTSGAHFLRINCVTPIGAHRLNGADRTDRRGKLVII

SEQ ID NO: 168976 - protein, 125 aa, Heterodera glycines
  Coding regions on vcDNA: vcDNA=SeqID_95399; Strand=-; Position=3-377
LTQQMVRNGKAVTICDQMNMRKRNKSLADNQSIPLFSFVVDGGGRVFRQNIIHLLAQMERVLVRHFPEKCFNHFGTVLCCSYCSTSSRTLSINRLDSSKKHSGMGANALCSASATIIRFSSSTLS

SEQ ID NO: 168977 - protein, 78 aa, Heterodera glycines
  Coding regions on vcDNA: vcDNA=SeqID_95400; Strand=-; Position=0-233
TIQQMIKNVKAVTICDQMNMRKRNKSLADNQSIPLFSFVVDGGGLVFRQNIIHLLAQMERVLVRHFSEKCFNHFGAVL

SEQ ID NO: 168978 - protein, 65 aa, Heterodera glycines; identical to SEQ ID NO: 127533
  Homolog annotation: Hit_ID=NP_510604.1; Match level="QueryCoverage =100%, HitCoverage=100%, E-value=1e-23, Identity=80%"; Hit description=ribosome associated membrane protein (XQ461) [Caenorhabditis elegans] emb|CAB03157.1| Hypothetical prot
  Coding regions on vcDNA: vcDNA=SeqID_95401; Strand=+; Position=72-269

SEQ ID NO: 168979 - protein, 153 aa, Heterodera glycines
  Coding regions on vcDNA: vcDNA=SeqID_95402; Strand=+; Position=2-460
SAVTPPTTTTTAAESGGEGDGRTETTSGQRKRHSANQTDSANGAAGGQGSNNAVVLSSSESAAKEAKVRKMSTTSQNKGHKSNTMAEDSGGGTGTSAASSGNGAEQNDNSRATRRPAELQHLIDYFPDQQSTDGNRMTRSKARAMQDKSSNSA

SEQ ID NO: 168980 - protein, 158 aa, Heterodera glycines
  Coding regions on vcDNA: vcDNA=SeqID_95403; Strand=+; Position=3-476
TTHRTEQFANKFLMSKHQKSAVTPPTTTTTAAESGGERDGRTETTSGQRKRHSANQTDSANGAAGGQGSNNAVVLSSSESAAKEAKVRKMSTTSQNKGHKSNTMAEDSGGGTGTSAASSGNGAEQNDNSRATRRPAELQHLIDYFPDQQSTDGNRMTR

SEQ ID NO: 168981 - protein, 162 aa, Heterodera glycines; identical to SEQ ID NO: 163474
  Homolog annotation: Hit_ID=NP_492437.1; Match level="QueryCoverage =99%, HitCoverage=99%, E-value=1e-73, Identity=82%"; Hit description =sorting nexin (1J640) [Caenorhabditis elegans] emb|CAA22253.1| Hypothetical protein W06D4.5 [Caenorhabdit
  Gene Ontology: Mol. function=protein binding; Cellular component =cytosol; Biological process=signal transduction
  Coding regions on vcDNA: vcDNA=SeqID_95404; Strand=+; Position=1-489

SEQ ID NO: 168982 - protein, 234 aa, Heterodera glycines
  Homolog annotation: Hit_ID=NP_491242.2; Match level="QueryCoverage =95%, HitCoverage=61%, E-value=2e-62, Identity=52%"; Hit description =transcription factor B1 mitochondrial (1E420) [Caenorhabditis elegans] gb|AAB42235.2| Hypothetical protei
  Coding regions on vcDNA: vcDNA=SeqID_95405; Strand=+; Position=25-726
MLKMRSVVPHFPPLPALRDFIYMYRMDADKTLSQNYLMDMNLTRKMVRRAGDLTNAFVVEVGPGPGGITRAILEQPCKRLDVVEIDKQFLMPLQHLSNHSMERMNVHRADVLKFDFEQVWTDAGAAKCSWVEEHPNFHIIGNLPFHISTPLVIKMMRQMSIRRGPFVFGRVPLTFTFQSEVARRVVGEPCTDFRSRIGVTCQNLTEPRILFNVPGKCFTPPPDHDVCVVQFLPR

SEQ ID NO: 168983 - protein, 57 aa, Heterodera glycines; identical to SEQ ID NO: 166596
  Homolog annotation: Hit_ID=NP_500801.2; Match level="QueryCoverage =100%, HitCoverage=12%, E-value=2e-15, Identity=66%"; Hit description= brg1 brm-associated factor 53A (48.4 kD) (4G161) [Caenorhabditis elegans] gb|AAF60947.2| Hypothetical pr
  Gene Ontology: Mol. function=chromatin binding; Cellular component =SWI/SNF complex; Biological process=signal transduction
  Coding regions on vcDNA: vcDNA=SeqID_95406; Strand=+; Position=2-175

SEQ ID NO: 168984 - protein, 229 aa, Heterodera glycines
  Coding regions on vcDNA: vcDNA=SeqID_95407; Strand=+; Position=2-691
ANNRLNLRNETEQNFPLNLCRPFASPPPKWTLWRFDCRDFPNHCTVKTCAFCAEVNKLRPTAKNIVNETHARWDSMKREKSFDDAPTLLRMATDTFLPSKLTKSVFFNHKLGVAIFRDEIPPKFESVENLSGGIFQLYFHGTSGRQSAVTVQKLDALFIQTVRSLFGMPSPIACHVHGLFYRCEINPGNRRDPISYGNLLDLPFMAKFEVPLCARNFLIRQNWQKSFKL

SEQ ID NO: 168985 - protein, 165 aa, Heterodera glycines; identical to SEQ ID NO: 163949
  Homolog annotation: Hit_ID=NP_497227.1; Match level="QueryCoverage =84%, HitCoverage=77%, E-value=1e-50, Identity=66%"; Hit description =cysteine-rich hydrophobic protein similar to CHIC1 and CHIC2 (19.8 kD) (3B256) [Caenorhabditis elegans] g
  Coding regions on vcDNA: vcDNA=SeqID_95408; Strand=+; Position=67-564

SEQ ID NO: 168986 - protein, 114 aa, Heterodera glycines
  Coding regions on vcDNA: vcDNA=SeqID_95409; Strand=+; Position=1-345
VPFISGILPLIPFISSSAASFGVTSKQSPLLNLGGAVNNAKELPVLAGAMVMLSLFQLAAAFSLLLYGCRTFGRTMRHVENIQRGINALQSQQNPGGEIGEQEKDAGGEMRRKL

SEQ ID NO: 168987 - protein, 207 aa, Heterodera glycines; identical to SEQ ID NO: 163063
  Homolog annotation: Hit_ID=NP_506241.1; Match level="QueryCoverage =89%, HitCoverage=77%, E-value=8e-50, Identity=51%"; Hit description =prion-like Q/N-rich domain protein PQN-69, Eukaryotic Initiation Factor, Prion-like Q/N-rich domain prote
  Gene Ontology: Mol. function=translation initiation factor activity; Cellular component=eukaryotic translation initiation factor 3 complex; Biological process=translational initiation
  Coding regions on vcDNA: vcDNA=SeqID_95410; Strand=+; Position=47-667

SEQ ID NO: 168988 - protein, 174 aa, Heterodera glycines; identical to SEQ ID NO: 163472
  Homolog annotation: Hit_ID=NP_509637.1; Match level="QueryCoverage =40%, HitCoverage=25%, E-value=8e-14, Identity=51%"; Hit description =putative secreted or extracellular protein precursor (XK352) [Caenorhabditis elegans] emb|CAA87334.2| Hyp
  Coding regions on vcDNA: vcDNA=SeqID_95411; Strand=+; Position=104-625

SEQ ID NO: 168989 - protein, 48 aa, Heterodera glycines; identical to SEQ ID NO: 166591
  Coding regions on vcDNA: vcDNA=SeqID_95412; Strand=+; Position=3-149

SEQ ID NO: 168990 - protein, 159 aa, Heterodera glycines
  Homolog annotation: Hit_ID=XP_319666.1; Match level="QueryCoverage =100%, HitCoverage=48%, E-value=2e-39, Identity=51%"; Hit description= ENSANGP00000021376 [Anopheles gambiae]
  Coding regions on vcDNA: vcDNA=SeqID_95413; Strand=+; Position=3-479
AADDCRKALDMDRKNVKANYYLGKVYVHQGQFDEAIKVLSRAHEGVLNLKQTYGDEITQLLRLARREKFRQEEDKRITQEIELQSYLNQLIDDDIAKKVNQLEDKKENDVEEKAEELKTQGDTFKKQLNNLFAQVDDRRRKRDLPDYLCGKISFELLKD

SEQ ID NO: 168991 - protein, 148 aa, Heterodera glycines
  Homolog annotation: Hit_ID=XP_319666.1; Match level="QueryCoverage =100%, HitCoverage=46%, E-value=7e-35, Identity=49%"; Hit description= ENSANGP00000021376 [Anopheles gambiae]
  Gene Ontology: Mol. function=chaperone activity; Cellular component =cytoplasm; Biological process=protein folding
  Coding regions on vcDNA: vcDNA=SeqID_95414; Strand=+; Position=32-475
MSSVPQLSASEHKERGNRYYQAGKYEEALSHYTRAIIKNPNDPTYFTNRALCNLNLKKWDSAADDCRKALDMDRKNVKANYYLGKVYVHQGQFDEAIKVLSRAHEGVLNLKQTYGDEITQLLRFRQEEDKRITQEIELQSYLNQLIDD

SEQ ID NO: 168992 - protein, 152 aa, Heterodera glycines
  Homolog annotation: Hit_ID=XP_417061.1; Match level="QueryCoverage =96%, HitCoverage=19%, E-value=2e-13, Identity=31%"; Hit description =PREDICTED: similar to SETDB2 protein [Gallus gallus]
  Gene Ontology: Mol. function=transcription factor activity; Biological process=regulation of transcription, DNA-dependent
  Coding regions on vcDNA: vcDNA=SeqID_95415; Strand=+; Position=1-456
ISNGFAAVPIPWVNDVDNFELAKFDYSPLPKFAENLPNRVFCNCKGTGGCSAQKGCACVEMSTIELSEPGRVHNAHLLSENAFESRFFECSSLCSCAGTCANRLAPQNDAQRNHLQIFKTLKAGFGCRALKPIRKGSFICFLGGEIFPFDYP

SEQ ID NO: 168993 - protein, 139 aa, Heterodera glycines; identical to SEQ ID NO: 163469
  Homolog annotation: Hit_ID=CAE56793.1; Match level="QueryCoverage =98%, HitCoverage=97%, E-value=2e-22, Identity=42%"; Hit description =Hypothetical protein CBG24605 [Caenorhabditis briggsae]
  Coding regions on vcDNA: vcDNA=SeqID_95416; Strand=+; Position=78-497

SEQ ID NO: 168994 - protein, 126 aa, Heterodera glycines
  Coding regions on vcDNA: vcDNA=SeqID_95417; Strand=-; Position=3-380
GSGTETWHLRQIQLRVDWPSKRKGRTKCGGKSSGGTLRLALVIVKLTAFVGGQRPRASTFSHPSVMVHTAGTANYSLTLAVAKSESHRQNGKDKQQMKCHFFLVPNSCSPGDPLVVERPPPRGAPA

SEQ ID NO: 168995 - protein, 201 aa, Heterodera glycines; identical to SEQ ID NO: 163467
  Homolog annotation: Hit_ID=CAE62200.1; Match level="QueryCoverage =97%, HitCoverage=97%, E-value=2e-54, Identity=56%"; Hit description =Hypothetical protein CBG06250 [Caenorhabditis briggsae]
  Coding regions on vcDNA: vcDNA=SeqID_95418; Strand=+; Position=74-679

SEQ ID NO: 168996 - protein, 211 aa, Heterodera glycines
  Homolog annotation: Hit_ID=CAE67356.1; Match level="QueryCoverage =70%, HitCoverage=53%, E-value=3e-27, Identity=38%"; Hit description =Hypothetical protein CBG12819 [Caenorhabditis briggsae]
  Coding regions on vcDNA: vcDNA=SeqID_95419; Strand=+; Position=19-654
MLPLTPAKRFVSKKHCVDSIRWLSLQRTTFAKTIPPGPLLFSHVYLPERTPDGQPQRKPSEHPDFMKYDFMADPEFEKPPPPVELFLLEDIKDLGEKFDIVKVSAEVARWDLLLKRRAVYASPFNLKYYAEKRKKYLAEMESRVRIPLDLLKMSALLMSQILPVTVSADVEWTLSSEMLINSTQSLGLYITEPGIIHLDNVSTLNGPRPEH

SEQ ID NO: 168997 - protein, 122 aa, Heterodera glycines; identical to SEQ ID NO: 166586
  Coding regions on vcDNA: vcDNA=SeqID_95420; Strand=+; Position=1-369

SEQ ID NO: 168998 - protein, 398 aa, Heterodera glycines
  Homolog annotation: Hit_ID=CAE63786.1; Match level="QueryCoverage =96%, HitCoverage=35%, E-value=1e-101, Identity=46%"; Hit description= Hypothetical protein CBG08327 [Caenorhabditis briggsae]
  Gene Ontology: Mol. function=general RNA polymerase II transcription factor activity; Cellular component=transcription factor TFIID complex; Biological process=G1-specific transcription in mitotic cell cycle
  Coding regions on vcDNA: vcDNA=SeqID_95421; Strand=+; Position=3-1196
HSQFFFDPNCPETCSPFYLDALFRKGHLVIRMLEKRLPKEQFVKVLQRILSLGVQYSQNLYRPVEWTHMLINTAMFLRVMTDVTGKELPSFVEQWIDFGGFVNFQVSHIFNRKRNIIELELRQTVPLREGCRNYTGPLAIVVQELGGLFAHTIQIDAAVSRHDIQCHSKGRKLKKKRIMLGTGEEVDVDLNSMDFDSPVLWIRVDPNLLLYRQMSINQPFYQWELMLLHERDVLAQQQAIETLCRFSEHKTKILLEETVRNDKFFYRIRREAAHCLVQIYNSLPESRLGESPPLIDYFRQNFGSKTSPDIPLPNNYAATSSNLQNNLLGQALPAAIGLIRGQDGRECPEYVLEFIINLIRLNDNSTNRYSDDYYRGALIHALGKTLTMSERTVEQPDC

SEQ ID NO: 168999 - protein, 108 aa, Heterodera glycines; identical to SEQ ID NO: 162680
  Homolog annotation: Hit_ID=NP_490812.1; Match level="QueryCoverage =95%, HitCoverage=98%, E-value=6e-29, Identity=57%"; Hit description =glutaredoxin (11.3 kD) (1B523) [Caenorhabditis elegans] gb|AAK29881.1| Hypothetical protein Y34D9A.6 [Cae
  Gene Ontology: Mol. function=glutaredoxin; Biological process=protein- disulfide reduction
  Coding regions on vcDNA: vcDNA=SeqID_95422; Strand=+; Position=74-400

SEQ ID NO: 169000 - protein, 193 aa, Heterodera glycines
  Coding regions on vcDNA: vcDNA=SeqID_95423; Strand=-; Position=1-579
TIPIVVHQSRKKRRFLVQNWSINTLKNQSVICLSSFSLSPSCHVCCCLRCCSNSAMHSRTNSRACTMSRFRRSCALRFALYVGRMTRPNSSMNSNSCWYLLPGMFWCGALTWYWGNEAMPTEGATTAEEETVCCCCCCCTWFAMVAACCWTIFCIANAAVAAAAVPPLVTGGSFSSALSMAQQFLLFFFNSSN

SEQ ID NO: 169001 - protein, 206 aa, Heterodera glycines; identical to SEQ ID NO: 163967
  Homolog annotation: Hit_ID=CAE60650.1; Match level="QueryCoverage =93%, HitCoverage=78%, E-value=3e-49, Identity=43%"; Hit description =Hypothetical protein CBG04296 [Caenorhabditis briggsae]
  Gene Ontology: Mol. function=histone binding; Cellular component =chromatin assembly complex; Biological process=loss of chromatin silencing
  Coding regions on vcDNA: vcDNA=SeqID_95424; Strand=+; Position=26-646

SEQ ID NO: 169002 - protein, 151 aa, Heterodera glycines
  Homolog annotation: Hit_ID=NP_497875.1; Match level="QueryCoverage =94%, HitCoverage=42%, E-value=3e-33, Identity=48%"; Hit description =leucine carboxyl methyltransferase (37.8 kD) (3F433) [Caenorhabditis elegans] emb|CAA84295.1| Hypothetica
  Gene Ontology: Biological process=leucine metabolism
  Coding regions on vcDNA: vcDNA=SeqID_95425; Strand=+; Position=27-479
MEAEADFDSGLLSTEVSHRRRSASVSEDYSVQKTNDDATECKFVAAQLGYYSDRFIPAFIHACNSEKPHHRDPEITRGYWARTNAITSMVVQFVQLAGPSTQILNLGAGFDTLYWRLKDAGLSFYKFVELDFSSVTAKKICQIKRNKNVNL

SEQ ID NO: 169003 - protein, 110 aa, Heterodera glycines
  Homolog annotation: Hit_ID=NP_508656.1; Match level="QueryCoverage =49%, HitCoverage=89%, E-value=7e-11, Identity=53%"; Hit description =putative endoplasmic reticulum protein, with a transmembrane domain (XE407) [Caenorhabditis elegans] gb|A
  Coding regions on vcDNA: vcDNA=SeqID_95426; Strand=+; Position=34-366
MKLVLFGVILLGTLLCQCHSDSVAVEQSKVDAVDVGDASHMMLTRAKRASGGRWTTQQIIECIFAIFIPPVAVLIHGGHEWVLHLIINIVLWILGWIPGTIHAFWYCFFR

SEQ ID NO: 169004 - protein, 66 aa, Heterodera glycines; identical to SEQ ID NO: 166578
  Coding regions on vcDNA: vcDNA=SeqID_95427; Strand=+; Position=2-202

SEQ ID NO: 169005 - protein, 146 aa, Heterodera glycines
  Homolog annotation: Hit_ID=NP_498082.1; Match level="QueryCoverage =70%, HitCoverage=80%, E-value=9e-20, Identity=44%"; Hit description =cytochrome c oxidase polypeptide via-liver mitochondrial like (14.7 kD) (3G171) [Caenorhabditis elegans]
  Gene Ontology: Cellular component=integral to membrane; Biological process=energy pathways
  Coding regions on vcDNA: vcDNA=SeqID_95428; Strand=+; Position=33-470
MLIKLVKATVGVPSPVALRAVSARGVGSGTHWIGNDFEDFDKHYKTGLRDAVPIAAFWKKFSAFVMMPLLVFAGYCGWKDHQNVHHSPRPEYVAYEYLATRRKPFPWGDGNHSLLHNPATNWVPGVGYEAPWPGDAHKKEGDSGGE

SEQ ID NO: 169006 - protein, 139 aa, Heterodera glycines
  Homolog annotation: Hit_ID=CAE73775.1; Match level="QueryCoverage =94%, HitCoverage=92%, E-value=6e-19, Identity=39%"; Hit description =Hypothetical protein CBG21319 [Caenorhabditis briggsae]
  Coding regions on vcDNA: vcDNA=SeqID_95429; Strand=+; Position=6-425
MALCVAIYDKHDALLYLRLKDRMSASPLEVQRFLHSSCDIVADKMNSPGNKATQQENFLGALLLSDRFRSFAYLTNTGTKFLLVIDAEEGTLKDHEIRLFFKNIHTKYCSAISNPFYSFGSTLQSSKIDAVVNELLTSF

SEQ ID NO: 169007 - protein, 175 aa, Heterodera glycines
  Homolog annotation: Hit_ID=CAB56513.1; Match level="QueryCoverage =82%, HitCoverage=49%, E-value=6e-23, Identity=43%"; Hit description =putative thioredoxin-like protein [Mortierella alpina]
  Gene Ontology: Mol. function=thiol-disulfide exchange intermediate activity; Cellular component=intracellular; Biological process =response to oxidative stress
  Coding regions on vcDNA: vcDNA=SeqID_95430; Strand=+; Position=75-599
MKKQPSALLPQRQQFRQLNPPLTHTMTSLANLHNATDDDHFGRLLESSVQSNVVVLNFHADWAPQCKQMNEVFGELAKLHPAVDFISIEAEELVDTSELFDIAAVPSFVVLKAGKPVDRVNGANAIELTNIVEKHAKAAKSRSAGANADFSDTASTAAGGAGADASMAAAPLAPA

SEQ ID NO: 169008 - protein, 166 aa, Heterodera glycines
  Coding regions on vcDNA: vcDNA=SeqID_95431; Strand=+; Position=2-499
TVVDVAEETVAQSMDQLEEGIEVGTVVNEEMAQNVPEEPMASVQLAKRSKPFNQRIVENIGWRKEFGRVPPKERDSLGLIECIDGATVGCNQRLLASLKSSNPSLFLRTDKFRSRNACGNKKSEVSLQIDEFDEFYKRWISNYEQEGAGKSHGEENSEHDGKEESE

SEQ ID NO: 169009 - protein, 144 aa, Heterodera glycines
  Homolog annotation: Hit_ID=NP_505451.1; Match level="QueryCoverage =65%, HitCoverage=17%, E-value=5e-10, Identity=33%"; Hit description =ligase family member (60.3 kD) (5J989) [Caenorhabditis elegans] emb|CAA94751.1| Hypothetical protein F11A
  Coding regions on vcDNA: vcDNA=SeqID_95432; Strand=+; Position=6-437
MFCQWRIKVKSNNFLNSFSFYCQKQCLFSSQEKCNNKNKYLPDEDGIVRSEFQSVPIQSEPFTETLLNRIRQFSAEQPKRAIFVDAENPSNITTFGQFLSKTHSAAHFLNSIGFSSGDVACVILPNCWHFFAIFLAASMHKACI

SEQ ID NO: 169010 - protein, 201 aa, Heterodera glycines
  Coding regions on vcDNA: vcDNA=SeqID_95433; Strand=+; Position=52-657
MSNSGELTFSDKDDVKGKTEDDKSRGTKRKKRKDSPSSSSSTSSSSSSSSSFSSSSESDDTSLSESEGPPAPSKVKKSKLTHVINPRKIFIHEYLMSKLHVSDVKRLPAEISQKYQMVQKELIGKFASGDYAKKPISFRIDEITLAGAAAQKAFNRGPTVAEYFLKKNGITLKHPQLPCLVQSGGGNHKSFYPMELLFFAQ

SEQ ID NO: 169011 - protein, 223 aa, Heterodera glycines; identical to SEQ ID NO: 163754
  Homolog annotation: Hit_ID=NP_788326.1; Match level="QueryCoverage =96%, HitCoverage=54%, E-value=2e-50, Identity=50%"; Hit description =CG30019-PC, isoform C [Drosophila melanogaster] gb|AAO41411.1| CG30019-PC, isoform C [Drosophila melanoga
  Gene Ontology: Mol. function=(S)-2-hydroxy-acid oxidase activity; Cellular component=peroxisome; Biological process=fatty acid alpha -oxidation
  Coding regions on vcDNA: vcDNA=SeqID_95434; Strand=+; Position=3-671

SEQ ID NO: 169012 - protein, 79 aa, Heterodera glycines
  Coding regions on vcDNA: vcDNA=SeqID_95435; Strand=-; Position=2-238
NINFIRSKKSKIIKINQQRNNIKRHVLFSTKTTTAWHGHYQSVRLSFPASPFLFALIFLAFLLSSVPSSAFCLSFSASF

SEQ ID NO: 169013 - protein, 156 aa, Heterodera glycines
  Coding regions on vcDNA: vcDNA=SeqID_95436; Strand=+; Position=9-479
VKPKLNLFMFFVNLAAILIFLQFYLDLTEAGIECQPNGVCRDVSGSTPASTVCSKKCYSCTYKNCCNKVYTSQYAKCSIKGWRKKGYIGNVPVEIGATKKRDVYCSKSNPCAKEGYKCVAYKKGDDRGFCWREKVEKGPPSSFALAIAIAGLVILL

SEQ ID NO: 169014 - protein, 214 aa, Heterodera glycines
  Homolog annotation: Hit_ID=CAE62916.1; Match level="QueryCoverage =100%, HitCoverage=37%, E-value=9e-76, Identity=61%"; Hit description= Hypothetical protein CBG07110 [Caenorhabditis briggsae]
  Gene Ontology: Mol. function=electron transporter activity; Cellular component=mitochondrial matrix; Biological process=proline catabolism
  Coding regions on vcDNA: vcDNA=SeqID_95437; Strand=+; Position=3-647
RMFVPKSLWPSIQKGLAELASQTKMGDVRDPSIFMSAVIDAKAFKRINDYIAYAKGAGVKKDGTRLVFGGKCDDSRGWFIEPTCVEVDNISSLLLKQEIFGPFIAVYVYNDVDAGQLVRSLKDQTPFGLTGAVFSQDKDFLYEAKDILRDAVGNLYLNDKCTGSVVGQQPFGGARQSGTNDKAGGPHYVLRWTSAQVIKKSFGPLTEWRYPHMD

SEQ ID NO: 169015 - protein, 114 aa, Heterodera glycines; identical to SEQ ID NO: 163339
  Coding regions on vcDNA: vcDNA=SeqID_95438; Strand=-; Position=115-459

SEQ ID NO: 169016 - protein, 154 aa, Heterodera glycines
  Homolog annotation: Hit_ID=NP_497707.1; Match level="QueryCoverage =93%, HitCoverage=63%, E-value=2e-20, Identity=39%"; Hit description =putative cytoplasmic protein of ancient origin (3E515) [Caenorhabditis elegans] emb|CAA91342.1| Hypotheti
  Coding regions on vcDNA: vcDNA=SeqID_95439; Strand=+; Position=15-476
MDNTNNKFILLKNGAKLFYASEECVRQEAKNFVGGIVGLNGPSDLEEGIYEGGLKIWECTVDLCNFLLSNYQTMSGIDILELGCGAALPSILALSMGADSICVQDFNTFVVECFTKRNFKLNGHKIDGGKCAFINGRWGGEILGKIGQKKFGLI

SEQ ID NO: 169017 - protein, 169 aa, Heterodera glycines
  Homolog annotation: Hit_ID=BAA22381.1; Match level="QueryCoverage =94%, HitCoverage=35%, E-value=4e-85, Identity=95%"; Hit description =beta-tubulin [Halocynthia roretzi]
  Gene Ontology: Mol. function=GTP binding; Cellular component=tubulin; Biological process=microtubule-based process
  Coding regions on vcDNA: vcDNA=SeqID_95440; Strand=+; Position=2-508
DPRAAGFGTRLVPFPRLHFFMVGFAPLTSRGSQQYRALTVPELTQQMFDAKNMMAASDPRHGRYLTVAAMFRGRMSMKEVDEQMLNVQNKNSSYFVEWIPNNVKTAVCDIPPKGLKMSVTFLGNSTAIQELFKRISDQFTAMFRRKAFLHWYTGEGMDEMEFTEAESNM

SEQ ID NO: 169018 - protein, 166 aa, Heterodera glycines; identical to SEQ ID NO: 162590
  Homolog annotation: Hit_ID=NP_500728.1; Match level="QueryCoverage =91%, HitCoverage=90%, E-value=2e-13, Identity=28%"; Hit description =putative nuclear protein of bilaterial origin (4F924) [Caenorhabditis elegans] gb|AAB88317.1| Hypothetica
  Coding regions on vcDNA: vcDNA=SeqID_95441; Strand=+; Position=2-502

SEQ ID NO: 169019 - protein, 222 aa, Heterodera glycines; identical to SEQ ID NO: 163443
  Homolog annotation: Hit_ID=XP_308965.1; Match level="QueryCoverage =87%, HitCoverage=45%, E-value=2e-75, Identity=73%"; Hit description =ENSANGP00000020214 [Anopheles gambiae]
  Gene Ontology: Mol. function=short branched-chain acyl-CoA dehydrogenase activity; Cellular component=mitochondrion; Biological process=electron transport
  Coding regions on vcDNA: vcDNA=SeqID_95442; Strand=+; Position=45-710

SEQ ID NO: 169020 - protein, 261 aa, Heterodera glycines
  Homolog annotation: Hit_ID=NP_741797.1; Match level="QueryCoverage =91%, HitCoverage=48%, E-value=4e-86, Identity=67%"; Hit description =MEChanosensory abnormality MEC-2, stomatin-like protein required for mechanosensation (51.9 kD) (mec-2) [
  Gene Ontology: Mol. function=protein binding; Cellular component =lipid raft; Biological process=signal transduction
  Coding regions on vcDNA: vcDNA=SeqID_95443; Strand=+; Position=50-832
MSSSTAELNPEDGGHPPQNTAVAIEQSQQAIHPPAQSGSGKIAAWASPNADDTEPYGICAKILIVLSYIITIITFPISVFMCIKIVQQYERAVIFRLGQLKKGGAKGPGLFFIIPCIDEYRKIDLRVVSFQVPPQEILSKDSVTVEVDAVVYFRVFNATISIVNIENSTGSTKLLAQTTLRNVLGTKTLSEMLSEREHISHQMQEVLDEATEHWGVKVERVEVKDVRLPREMQRAMAAEAEATREAKAKVIAAQGEQQASR

SEQ ID NO: 169021 - protein, 132 aa, Heterodera glycines
  Coding regions on vcDNA: vcDNA=SeqID_95444; Strand=+; Position=2-397
ENECGQCKHCLDKNDCFLNMITAWAQNGEIEWPRVLGENPNLWGKEQKVLADAKATEDKQFQDPKFEQNFKAMNAIGMAHRGAYHYFRGEPGSAGALEQVRHFLNTSIRAGFNVHKDFAVVNVEIYKNEGAD

SEQ ID NO: 169022 - protein, 234 aa, Heterodera glycines
  Homolog annotation: Hit_ID=CAE56805.1; Match level="QueryCoverage =81%, HitCoverage=38%, E-value=4e-50, Identity=53%"; Hit description =Hypothetical protein CBG24618 [Caenorhabditis briggsae]
  Coding regions on vcDNA: vcDNA=SeqID_95445; Strand=+; Position=3-704
DISSSQLKIFSVFLLFIDFVFPNNHENFVTLAQFRAGGEKFSFAERRFLLYDVNPGEGFNLRRDVYLRVANTVRQLREKGFDFVLVLPPWGNCWHWRTKPRQTKIRWSELFDLDSLSDFVPVIEFDEFLEAQGTSVSTVLYLQHYAEGWAEGGEYTLKYDIRPCIEADKYYAKRGDKWNGHFFDYADHFHAKDLQCLSIQGQSSTLAEAIAQLFPEGRSLMVDRAETILHDQFG

SEQ ID NO: 169023 - protein, 138 aa, Heterodera glycines; identical to SEQ ID NO: 158760
  Homolog annotation: Hit_ID=AAO33474.1; Match level="QueryCoverage =100%, HitCoverage=100%, E-value=4e-73, Identity=100%"; Hit description=gland-specific protein g4g12 [Heterodera glycines]
  Coding regions on vcDNA: vcDNA=SeqID_95446; Strand=+; Position=36-452

SEQ ID NO: 169024 - protein, 41 aa, Heterodera glycines; identical to SEQ ID NO: 166559
  Coding regions on vcDNA: vcDNA=SeqID_95447; Strand=-; Position=2-124

SEQ ID NO: 169025 - protein, 35 aa, Heterodera glycines; identical to SEQ ID NO: 166558
  Coding regions on vcDNA: vcDNA=SeqID_95448; Strand=-; Position=0-104

SEQ ID NO: 169026 - protein, 149 aa, Heterodera glycines; identical to SEQ ID NO: 166557
  Homolog annotation: Hit_ID=NP_509485.1; Match level="QueryCoverage =65%, HitCoverage=47%, E-value=4e-09, Identity=35%"; Hit description =titin like (XJ383) [Caenorhabditis elegans] gb|AAA82383.1| Hypothetical protein M02D8.1 [Caenorhabditis e
  Coding regions on vcDNA: vcDNA=SeqID_95449; Strand=+; Position=32-481

SEQ ID NO: 169027 - protein, 181 aa, Heterodera glycines
  Coding regions on vcDNA: vcDNA=SeqID_95450; Strand=+; Position=6-551
MQQKCTFSLITQDKTEVVVPSDFVDQSDMLSDYAKMQRQNNGDAEELQAKFEMTNEMPLISKFHLEMIFEFLGTYREEKQKENEGAADEKQTTKSGERVAEATAEESAELSTMPKWAFDLFDKLPKNDLFLAMNAANYFGIAPFVSLSAAFVCFQILQKKGKREVAEYLNMDENDNNNNGK

SEQ ID NO: 169028 - protein, 231 aa, Heterodera glycines
  Homolog annotation: Hit_ID=CAE75428.1; Match level="QueryCoverage =95%, HitCoverage=73%, E-value=4e-36, Identity=38%"; Hit description =Hypothetical protein CBG23421 [Caenorhabditis briggsae]
  Coding regions on vcDNA: vcDNA=SeqID_95451; Strand=+; Position=43-735
MTYEEDYMSSAFLAKVEDVKPGVGTGREGRRILRINANREEAIERQRVEKPKSKAELERDRLMEGLNNPIRAESKGFQLLAKMGYKEGMRMGRSAADEQQMDSRTKEPILIQLRIDRSGVGMDEHRKEKQRDLCEAHMERMKRQADNEEELAIDFRRRKRAAMEMKQLISEIQKLRKTCQEMDMRMGKTIPDEFWFWPIYSNNNELVDMVEVVDKSNQSMDENKRTKREPS

SEQ ID NO: 169029 - protein, 239 aa, Heterodera glycines
  Coding regions on vcDNA: vcDNA=SeqID_95452; Strand=+; Position=11-730
MAMIPFNLFLLSALFFTANAYDLIFKNISVPDELKDKFECTFEVKKGNGENECGLGELETDGRRNGELKWAEDKLCIKVKCEEKGNDTKFAFRLQQCELVDLKKSDKPMKRPIHLIDSNGCLASNAKGQWPKLNPPLNYSFEERTVEMRGWTFGNETDIGQFPDEATLSCAVEICADPCEQSCLDKISLDKCSLNDFIGDKNATDICHEGNAAAVQGTISFCLMTLLMFLCSSTVLMFQ

SEQ ID NO: 169030 - protein, 195 aa, Heterodera glycines; identical to SEQ ID NO: 163451
  Coding regions on vcDNA: vcDNA=SeqID_95453; Strand=+; Position=1-588

SEQ ID NO: 169031 - protein, 162 aa, Heterodera glycines; identical to SEQ ID NO: 166552
  Coding regions on vcDNA: vcDNA=SeqID_95454; Strand=+; Position=79-564

SEQ ID NO: 169032 - protein, 128 aa, Heterodera glycines
  Coding regions on vcDNA: vcDNA=SeqID_95455; Strand=-; Position=33-419
KLTPFFYRSLLLSSSSAACVANVKKGSQIVSESDVSPFGAAAPWVDAHVETRAGQKGLLLLQIGRIVIIGHGFNAIGEEQIQKKPKENETHRPDLGVEFEVERCTKNAMPSHFFVGVKRRNSKGATLS

SEQ ID NO: 169033 - protein, 137 aa, Heterodera glycines
  Coding regions on vcDNA: vcDNA=SeqID_95456; Strand=+; Position=88-498
MLQFEEAMAQFNAMFPNLNSSVVESVLRNCDGDVSRTIDELLRRSGQEEGNNSETDERRKSVSTPPRDQCANDEKIALLVQNREFLRYLRRDPNFQREMLGRSNSSDYRHRHHSSTHRRRNLPVLLTSSRTSQSPNS

SEQ ID NO: 169034 - protein, 81 aa, Heterodera glycines
  Coding regions on vcDNA: vcDNA=SeqID_95457; Strand=+; Position=5-250
HFVFKKTFNGVGGMTPVPMLRKHPTFTALRKILKKRKKNLKNLFCCCYWCFTLYLLKLFQNWISWSSSNDGLFAIMPDKNE

SEQ ID NO: 169035 - protein, 226 aa, Heterodera glycines
  Coding regions on vcDNA: vcDNA=SeqID_95458; Strand=+; Position=3-680
SLSKMRLASLFSVLLFLLFIHRTIPSPSPKFDEAIKDNGIFAFDSSVEDSAEEVPPSPAFADSLRSPHSSEAEEDGPSAEEEEQFVDNVAGWRPRPSFLPPFAVQNRCLKAKFFDSKSDECRPCSICGPDLYEREKCRTDSDTVCEWCLTNLRVIVRNSDFRVKCEQLIALRDQFRAALVQHSVVEGKAKPTIYSVSMFENASKLWKIELFVEMAFYITLIALVLA

SEQ ID NO: 169036 - protein, 161 aa, Heterodera glycines; identical to SEQ ID NO: 163757
  Homolog annotation: Hit_ID=CAE61639.1; Match level="QueryCoverage =96%, HitCoverage=96%, E-value=7e-34, Identity=49%"; Hit description =Hypothetical protein CBG05572 [Caenorhabditis briggsae]
  Gene Ontology: Biological process=mechanosensory behavior
  Coding regions on vcDNA: vcDNA=SeqID_95459; Strand=+; Position=34-519

SEQ ID NO: 169037 - protein, 131 aa, Heterodera glycines
  Homolog annotation: Hit_ID=NP_494762.1; Match level="QueryCoverage =95%, HitCoverage=74%, E-value=5e-47, Identity=65%"; Hit description =putative protein of eukaryotic origin (2E613) [Caenorhabditis elegans] gb|AAF39886.1| Hypothetical protei
  Coding regions on vcDNA: vcDNA=SeqID_95460; Strand=+; Position=83-475
MDIRSDQHRYPFCIVWTPIPLISWLFPFIGHIGIATSKGIIRDFAGSNYVSEDNMAFGWPTLYHQLNPEKVNGGSEAWDNSVAEASDEYKRRLHNLFLDNCHSHVSLALNTMRYDGKSNWNNFRVAADINL

SEQ ID NO: 169038 - protein, 109 aa, Heterodera glycines
  Coding regions on vcDNA: vcDNA=SeqID_95461; Strand=-; Position=145-474
APLSLFSVSIVVRKQVPPTFSCTTPSGTSVAPAGMPMFIAKAPSMFSSSLIDRRVPWCFAVPYLLLVPSRLPFLETHFPIEFFAVRRFGRASTFLNNVRENFAVSFVGL

SEQ ID NO: 169039 - protein, 119 aa, Heterodera glycines
  Homolog annotation: Hit_ID=ZP_00357698.1; Match level="QueryCoverage =64%, HitCoverage=35%, E-value=1e-13, Identity=62%"; Hit description =hypothetical protein Chlo02002738 [Chloroflexus aurantiacus]
  Coding regions on vcDNA: vcDNA=SeqID_95462; Strand=-; Position=104-463
FFFFFFFFFFFFFFFFFFFFFFFFFFFYYYFYSIIFLLTIRLLVQLISRISVQIPCPFRCPCPCPFRCPCPFRRPCPFRRPFHRQIRRRPFHRRSHSHHSRSHHSHSHAFAEVEHYQFH

SEQ ID NO: 169040 - protein, 45 aa, Heterodera glycines
  Coding regions on vcDNA: vcDNA=SeqID_95463; Strand=-; Position=3-137
VCVLSKKKNREDTTKQIQKMVINFVFLSSVALIKCPDALCQASRK

SEQ ID NO: 169041 - protein, 37 aa, Heterodera glycines; identical to SEQ ID NO: 166543
  Coding regions on vcDNA: vcDNA=SeqID_95464; Strand=-; Position=61-174

SEQ ID NO: 169042 - protein, 91 aa, Heterodera glycines; identical to SEQ ID NO: 166542
  Homolog annotation: Hit_ID=CAE64436.1; Match level="QueryCoverage =97%, HitCoverage=11%, E-value=2e-09, Identity=33%"; Hit description =Hypothetical protein CBG09139 [Caenorhabditis briggsae]
  Coding regions on vcDNA: vcDNA=SeqID_95465; Strand=+; Position=15-290

SEQ ID NO: 169043 - protein, 221 aa, Heterodera glycines
  Coding regions on vcDNA: vcDNA=SeqID_95466; Strand=+; Position=217-879
MCFSGWIPPFWLPLVKNTTRPTTPVLLCQVRRLLSLNSNSPSKMVVARLLLLQWLMVEVANSIKSLLSRNLKRRPLSWITHLKRNRKKPDAPSDAAPTVVDSLPSPTSTPNKKDEVMAISAVAPPSSIVDVPKTDDTAPPPSLSQPVAATAAAAPPPTSEQQPNPAVVTTAAANNTNNSLAQRPKSVVAGSYAAIAAAARGNGPNNVDNIVTVHVPAATNG

SEQ ID NO: 169044 - protein, 102 aa, Heterodera glycines
  Coding regions on vcDNA: vcDNA=SeqID_95467; Strand=+; Position=1-309
ERCLTASFFALIPLIAQAFIGKASPVAVLQVRFNCPWHRSGYTPNFFGFKVKRKLKMRTVERLSQTEGSRHILMRRVLSEKHFVAWNWPSKKPRNDRLNYPL

SEQ ID NO: 169045 - protein, 145 aa, Heterodera glycines; identical to SEQ ID NO: 163444
  Coding regions on vcDNA: vcDNA=SeqID_95468; Strand=+; Position=5-442

SEQ ID NO: 169046 - protein, 172 aa, Heterodera glycines
  Coding regions on vcDNA: vcDNA=SeqID_95469; Strand=+; Position=41-556
WIPRAAGYSARGKEFDHSEEVVTKITLETILFNFGNLSVHTTRANNLDTKHSAGRDTEKMLQSDCHLPKVPLRYFPYKVPRRFLLAKQRQKLRNSQSDSAGSTFSYENSLLNARLDGCEFDGRSLTSDTKEFADVQQSKQTAEKRPRCPSSSATSAFSAYRTAPPPPRPCWL

SEQ ID NO: 169047 - protein, 47 aa, Heterodera glycines
  Coding regions on vcDNA: vcDNA=SeqID_95470; Strand=-; Position=0-140
ERKKELRHQNAEFGTPFHIVGKLKQRLVVKSSGRTLLATFFSAQYPA

SEQ ID NO: 169048 - protein, 185 aa, Heterodera glycines
  Homolog annotation: Hit_ID=NP_510634.1; Match level="QueryCoverage =90%, HitCoverage=51%, E-value=8e-42, Identity=49%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_95471; Strand=+; Position=3-557
SNEDFDYLSALSGLYTASVERRKCNLLVLVQGNLDNLEGKMVILTIHDVGKNHLSFVDFVNSLSMAPLRGRSLFLHICVPGQEPDVPIFAGSSFPSMDQLGHAMVQVLRHFKISHCFAMGEGAGADICCRFALDFPSMVRGLVLIHCTSTTHGIVENIKEIFAGLRLEDGEMTHSAWNYLLTHRF

SEQ ID NO: 169049 - protein, 304 aa, Heterodera glycines
  Coding regions on vcDNA: vcDNA=SeqID_95472; Strand=+; Position=3-914
LFEQMLEVRAVGTNIGKEQDGPSYEMLFRLTTTNRSKSAPFLAKIPTKTLKREVANEAKTNNSTNDDERKEEEQFASLKNRCHTIASTSAPFASTKVQQNGVDSNHSPSAKQSSSSSPVASTKTFRRRTAFETSEAMREIFGAYSPFSSQKKENSGEFNRKKMALENGRTMNGTQQNNKTAIRPSEFEDDTESRDFENLSMSVSEASSEVGSVSIQDGAMLNQNERPMLENGITKRNVRLKSDLRISPASSGSWERAIRPVVNKHHNANAASVGRRPAANTQRSSVCWYCGVKGHAAAHCQKKR

SEQ ID NO: 169050 - protein, 268 aa, Heterodera glycines
  misc_feature (150)..(150): Xaa can be any naturally occurring amino acid
  Homolog annotation: Hit_ID=AAQ12016.1; Match level="QueryCoverage =100%, HitCoverage=93%, E-value=1e-131, Identity=95%"; Hit description=tropomyosin [Heterodera glycines]
  Gene Ontology: Mol. function=structural constituent of muscle; Cellular component=muscle thin filament tropomyosin; Biological process=pole plasm oskar mRNA localization
  Coding regions on vcDNA: vcDNA=SeqID_95473; Strand=+; Position=77-878
MDAIKKKMQAMKIEKDNAIDRADAAEEKCRQTQERLERVEEELRDTQKKMMATENELDKAQEDLTAANNLLEEKEKKVQEAEAEVASLNRRMVLLEEGVGTSLRSALKLATEKMEEATANCDESERVRKVMENRSLQDEERANAIEEQLXKEAQSLAEEADRKYDEVARKLAMVEADLERAEERAEAGENKIVELEEELRVVGNNLKSLELSEEKALQREEAYEEQVRQMEVRLKEAETRAEFAERSGQKLQKGVDRLEDELVHEKER

SEQ ID NO: 169051 - protein, 155 aa, Heterodera glycines; identical to SEQ ID NO: 166522
  Coding regions on vcDNA: vcDNA=SeqID_95474; Strand=-; Position=1-465

SEQ ID NO: 169052 - protein, 133 aa, Heterodera glycines
  Homolog annotation: Hit_ID=NP_572952.1; Match level="QueryCoverage =93%, HitCoverage=19%, E-value=6e-35, Identity=55%"; Hit description =CG1810-PA [Drosophila melanogaster] gb|AAF48361.1| CG1810-PA [Drosophila melanogaster] gb|AAQ22434.1| RE7
  Gene Ontology: Mol. function=protein tyrosine phosphatase activity; Cellular component=nucleus; Biological process=RNA processing
  Coding regions on vcDNA: vcDNA=SeqID_95475; Strand=+; Position=1-402
ATKGAKIGLWVDLTNSDNFYNEEEVLNNGSKFLKMKMVGHKQTPTPEQTTAFIEAIDRFITNNPDDVIVVHCTHGFNRTGFLISAYLYEKCDMSIEMAVREFAECRPNGIYKQYYLDDLRKRYGDEDEDEMTV

SEQ ID NO: 169053 - protein, 125 aa, Heterodera glycines
  Coding regions on vcDNA: vcDNA=SeqID_95476; Strand=+; Position=2-379
RNIAMGKYDPEEGYDSNLTDLKLFEAGEPFEMQIKLLKRPSEDNLPMTEILSSISLSLTMTVIVSTPKGTSQTNYTLDSESYRDMNYITVRGDLELFAEPSLLNDITHPILPVLILHRYRLYWYR

SEQ ID NO: 169054 - protein, 227 aa, Heterodera glycines
  misc_feature (88)..(88): Xaa can be any naturally occurring amino acid
  Homolog annotation: Hit_ID=NP_501841.1; Match level="QueryCoverage =80%, HitCoverage=19%, E-value=3e-18, Identity=31%"; Hit description =cutlet (96.9 kD) (4K888) [Caenorhabditis elegans] emb|CAA93081.1| Hypothetical protein K08F4.1 [Caenorhab
  Gene Ontology: Cellular component=nucleus; Biological process=cell proliferation
  Coding regions on vcDNA: vcDNA=SeqID_95477; Strand=+; Position=200-879
FLAESATTRKQDTAQLESADLAFANLMQAEERVHEREQEQRLRNSQSVQMEVDKFQSSQSLTGKRTHKFTLWVDKYAPSTFLDLLTKXLLLWLRLWDECVFEKRGGKKWEGNHRRISQRNNANATSLWDNLEERDRTLFEMERPKGTDSRMPKQKILALFGPSGVGKTSLARVAAEQAGYRPVIIPISELQNMAELKSRLENATDCTSIDALFHNLSVSAASAGEAP

SEQ ID NO: 169055 - protein, 106 aa, Heterodera glycines
  Coding regions on vcDNA: vcDNA=SeqID_95478; Strand=+; Position=67-387
TTPLIRDFSLYQFFFYFGLFYFCSTPSLISGQPISFISGQPPFPISLSSLKIFPFNYRSVPFSPFILVNLPQSFRSVPFPHLLIKWHKFSLGQCHSSFFSNCAQFF

SEQ ID NO: 169056 - protein, 279 aa, Heterodera glycines
  misc_feature (195)..(195): Xaa can be any naturally occurring amino acid
  Homolog annotation: Hit_ID=AAD39095.1; Match level="QueryCoverage =97%, HitCoverage=97%, E-value=2e-48, Identity=34%"; Hit description =galectin GAL-1 [Teladorsagia circumcincta] gb|AAC47546.1| galectin [Teladorsagia circumcincta]
  Coding regions on vcDNA: vcDNA=SeqID_95479; Strand=+; Position=84-922
MPSSDFPMPYTSRLSEPCLAPGQSLVFQGSVDSDARHFELSLISGVPNSGQERIALQICFHFEVGITILNSMLENGEWGEEEFHSNPFFHGKPFDVRIRVHEKRFDFFVNQVPWAVFEHRTDFRKIDHIQASGDVSLSAVHWGGRYFEMPYEMTFHDHALESGQRLFVYGIPRRRFRRFTDQRQFGGAVQNECTXFDKQIVVRNAQTDKEWGAEESEGGPFPFRKGEGFDLVILNEPLALQISINGTPFCSFFHRTIDAHKDYKKVRISGEVELTGHGK

SEQ ID NO: 169057 - protein, 170 aa, Heterodera glycines; identical to SEQ ID NO: 163075
  Coding regions on vcDNA: vcDNA=SeqID_95480; Strand=+; Position=1-513

SEQ ID NO: 169058 - protein, 61 aa, Heterodera glycines
  Coding regions on vcDNA: vcDNA=SeqID_95481; Strand=-; Position=90-275
ICIIFNLNIYFCTFCTLICQQFVVETKHTLLINLIVQLLSLCHPPPKKKNFHNSQMICCPI

SEQ ID NO: 169059 - protein, 292 aa, Heterodera glycines
  Homolog annotation: Hit_ID=AAM61698.1; Match level="QueryCoverage =60%, HitCoverage=47%, E-value=7e-16, Identity=29%"; Hit description =UVB-resistance protein-like [Arabidopsis thaliana]
  Gene Ontology: Mol. function=Rab guanyl-nucleotide exchange factor activity; Cellular component=vesicular fraction; Biological process =endosome organization and biogenesis
  Coding regions on vcDNA: vcDNA=SeqID_95482; Strand=+; Position=2-877
VQLVHSEFPPPSVALSHQFDHWDALRGRKGIDKFEHFSAASSTKSNRFLVCTAFGAFLATNFENCAVLERICDSRLGKNPKEVKRFELPFRIGKISAGRDHLIILDSLNGEIWSFGTGTRGELGTGRVEADNWAEGPRRIPSFSEADIRCVDIESGAWHSLALTAEGDVYGWGWNGHGQIGHLSTEFSIQPTPFPFDLGDGRATMIRCAGNNSFLLLSDGSEMEFGEICTEKPMDEQMAEKMPENGSKNGTEKDEKKGQSQEKDGKEKRQSPSAKRQRHQRTLKVAVVGCSH

SEQ ID NO: 169060 - protein, 393 aa, Heterodera glycines
  Homolog annotation: Hit_ID=CAC00543.1; Match level="QueryCoverage =97%, HitCoverage=80%, E-value=1e-123, Identity=57%"; Hit description= necepsin II [Necator americanus]
  Gene Ontology: Mol. function=aspartic-type endopeptidase activity; Cellular component=extracellular space; Biological process=induction of non-apoptotic programmed cell death
  Coding regions on vcDNA: vcDNA=SeqID_95483; Strand=+; Position=18-1196
MVNKFLPLIIFVFLLIDTAICRHHHRHSHHHHQQNEQPEMISVPLRRMDTVRARLALTGSLEQFRKHRTESLRRTVERMNNNYNNNEEYSSAESDQEQMEMAQNGARVGTEIDELLRNYMDAQYYGDISIGSPAQNFTVIFDTGSSNLWVPSKKCPIYDIACSLHHKYDGAKSTSYQPDGRKVAIQYGTGSMKGFVSKDIVCMANICVQKQEFTEATSGPGLTFVAAKFDGILGMGFSEISVQKLPTVFDNMVTQQKVPEPVFAFWLNRDPTSEFGGEITIGGTDQRRFVAPITYTPVTHKAYWQFKMDSISGGNGKLACQNGCQAIADTGTSLLAGPKNDIEKIQKHIGAIPLFHGEYMISCERIPTLPDVTINIGGQAYTLKGQDYVLKMT

SEQ ID NO: 169061 - protein, 262 aa, Heterodera glycines
  Homolog annotation: Hit_ID=CAE62763.1; Match level="QueryCoverage =93%, HitCoverage=57%, E-value=9e-67, Identity=53%"; Hit description =Hypothetical protein CBG06929 [Caenorhabditis briggsae]
  Gene Ontology: Mol. function=pyruvate dehydrogenase (lipoamide) kinase activity; Cellular component=mitochondrion; Biological process=glucose metabolism
  Coding regions on vcDNA: vcDNA=SeqID_95484; Strand=+; Position=19-804
MRLSLSRFASTVAMFAGGPIERPLAYYSQFRPASLTMHQYLDFGRKGSAFTSYHFLKTELLVRMANIMQEFDLLPAKLMQTPSARHVGSWYKQSFSELLHFEGLEPSDMVLDKFNNQLRTILHRHNTVVETMAEALLELKESHGVDIACERNIQYFLDRFYLNRISIRMLQNQHLAIFAAACDTNGTNNQSRKTVVVDPAGHVGHIDPQCNVRDILLDAYENARFLSEQHFCVSPMLDLRCFNTRIPDQQISVPLVPLHLYY

SEQ ID NO: 169062 - protein, 442 aa, Heterodera glycines
  Homolog annotation: Hit_ID=XP_517630.1; Match level="QueryCoverage =99%, HitCoverage=89%, E-value=2e-76, Identity=36%"; Hit description =PREDICTED: similar to membrane-associated RING-CH protein VI; similar to S. cerevisiae SSM4 [Pan troglody
  Coding regions on vcDNA: vcDNA=SeqID_95485; Strand=+; Position=1-1958
IEQPISRHLRRLVTSITLFFTIILLVVYVPVRVIKWLCPSTLPYVFSGSADTPLVEYSFELVLLQVIMPSILEYSKAFSLLKRTVRIWCRVVGGWLSLDSYLLPADKEKRNGGQQHREQQRQRARERAQLHREQRNLGAQHQALLRFRDSSVPEEYVQPNLFPLRISLLLFFVALPTIAISLLFFLIPVTIGRFLLSTLALTNQPIHDLYTIAVGLYACWICVRLGLLSREWARRGWTYVKKLFNATVFLLVRVFAAAFPLLAVIPFMLGLYFQMLVISPLRVAIFQSPLFFPWKEWAMGVVHFKIVCASVLMGPDWWLKTAFEQVQQRTCAGLSLFVFIIYADGIWNIRLRDLYTNLVFPIVNTLTFLIAFPYVLSNFLLFFVDASREEQIIVIRFAYPFLLGSICFCALITWQWQKLKLLAQKIRNDKVLCFATLIMNIG

SEQ ID NO: 169063 - protein, 160 aa, Heterodera glycines
  Homolog annotation: Hit_ID=NP_500341.1; Match level="QueryCoverage =99%, HitCoverage=34%, E-value=1e-61, Identity=66%"; Hit description =nicotinic receptor family member (53.3 kD) (4E181) [Caenorhabditis elegans] gb|AAB92023.2| Hypothetical p
  Gene Ontology: Mol. function=serotonin-activated cation-selective channel activity; Cellular component=integral to plasma membrane; Biological process=synaptic transmission
  Coding regions on vcDNA: vcDNA=SeqID_95486; Strand=+; Position=60-539
MLSWDPAAFSGLRQIVVPRADVWLPKLFIYNSMDTKEMLADNYFDVRLTHQGKLKINIPHYVTCICRLDIALFPFDTQFCAIAQASPLLGVEEMDVNVTMPPKDSYFSGNAEWELFNVSVRDTKFWEDGERRVEVHYVMHMRRRPVYYLTVIVAPTFLIS

SEQ ID NO: 169064 - protein, 150 aa, Heterodera glycines
  Homolog annotation: Hit_ID=NP_493364.1; Match level="QueryCoverage =91%, HitCoverage=27%, E-value=1e-34, Identity=49%"; Hit description =mitochondrial substrate carrier (55.1 kD) (1O25) [Caenorhabditis elegans] emb|CAA21607.2| Hypothetical pr
  Coding regions on vcDNA: vcDNA=SeqID_95487; Strand=+; Position=26-475
MIASNSAGAPYRGDPMASAALGFSNFVNGALIRHPFVVLRRQCQVHDHATRKHLTPISLLPVVVNLAGKDGTFSLWKGAIGSGVLWVVSHASEFLIAQLFNLPKSFVPQGSSERFWRHVFLKTASFLACTPFIGSSFIETVRSGGRLSDE

SEQ ID NO: 169065 - protein, 63 aa, Heterodera glycines
  Coding regions on vcDNA: vcDNA=SeqID_95488; Strand=-; Position=2-190
GNSTLLILCVSNWKEAGFEELLAKNIERSGYTVPRKIQSRTIPLIMDGLYWISCLLIDLSAIL

SEQ ID NO: 169066 - protein, 66 aa, Heterodera glycines
  Coding regions on vcDNA: vcDNA=SeqID_95489; Strand=+; Position=176-376
SIPNWRIGGNLFGDGPILMESKNPMEICQGKITKEQLRFGYEALGRIERHVQKGTFGRDFVEAMNE

SEQ ID NO: 169067 - protein, 169 aa, Heterodera glycines
  Coding regions on vcDNA: vcDNA=SeqID_95490; Strand=+; Position=1-507
ECFLTKAPLCPEMSMEQQDGLWPLSSTDRCQSRANCNAIGENGGLVTLSGEETDESQCTTPTETLSPIVRRKTTDSKEGTKIREEKRAVEGTHGNVKVTDGIMLEKRGTQRATERQNNDERETDNRAPLDSPRSQNQHCTDVLIPTSNPIFAPCARPFFHNKMPILRPN

SEQ ID NO: 169068 - protein, 73 aa, Heterodera glycines; identical to SEQ ID NO: 166506
  Coding regions on vcDNA: vcDNA=SeqID_95491; Strand=+; Position=94-315

SEQ ID NO: 169069 - protein, 154 aa, Heterodera glycines
  Coding regions on vcDNA: vcDNA=SeqID_95492; Strand=+; Position=1-462
PNYNRNQYFKSIIDSLSQKGLLEANRQPPISHSTLSFLMERKKDPMSMVNIYCSASGEPNFEFFVFQLAVRPSKFVFIFELRSRPVYGFCAASKKEAKKACALRLLDILMTEERLECVNLSGRKVRKMPPKPIPTKAANVEQSQQQENMHLSFS

SEQ ID NO: 169070 - protein, 158 aa, Heterodera glycines
  Homolog annotation: Hit_ID=AAO51879.1; Match level="QueryCoverage =87%, HitCoverage=20%, E-value=3e-09, Identity=31%"; Hit description =similar to F53F10.5.p [Caenorhabditis elegans] [Dictyostelium discoideum]
  Coding regions on vcDNA: vcDNA=SeqID_95493; Strand=+; Position=3-476
KTTAPMTPTTTALTTSAGSPFAFGSSASTTASPGATTTTASATLPLLFGTQQKTTAPAAVPSSVPAFSFGTAKFPSFGSSAAGGTLFGSTTANTLTTSSQPHVNGGSRKRSAAQSVDDISPYGKRTASSSLTETSSIANAPLFGGALTMTTKPNTAID

SEQ ID NO: 169071 - protein, 230 aa, Heterodera glycines; identical to SEQ ID NO: 139868
  Coding regions on vcDNA: vcDNA=SeqID_95494; Strand=-; Position=1-690

SEQ ID NO: 169072 - protein, 55 aa, Heterodera glycines
  Coding regions on vcDNA: vcDNA=SeqID_95495; Strand=+; Position=2-166
FNYSTKFLKFYWLPALPDSEILLNQIYQNVKLIPSLPSKNYFLNNELKNLVTPKG

SEQ ID NO: 169073 - protein, 76 aa, Heterodera glycines
  Coding regions on vcDNA: vcDNA=SeqID_95496; Strand=+; Position=236-463
FFQNCSFQILKMVLLTEKIAKILNCRVSELRDRLNHPSDCETVVKALTGHRVKTTYKDRNGYTKSFAFGGITAQGA

SEQ ID NO: 169074 - protein, 250 aa, Heterodera glycines
  misc_feature (182)..(182): Xaa can be any naturally occurring amino acid
  Homolog annotation: Hit_ID=CAE71346.1; Match level="QueryCoverage =95%, HitCoverage=60%, E-value=3e-57, Identity=46%"; Hit description =Hypothetical protein CBG18249 [Caenorhabditis briggsae]
  Coding regions on vcDNA: vcDNA=SeqID_95497; Strand=+; Position=97-845
MSARIQHEAFFEHFGIVLDNAEGVYFSGQEIAGKVVIECREPRRISELLLEVKGRARTHWTKSRKMCSENETYFCEQFNTEYTRKLPKTEAENDAGGETPREGGRTVAERRRESIKMMGRLLHVGTHEIPFSYALPKSLPSSFEGEFGFVRYTCRAICESPWDFDTVCFLPFTVIGIEDLNXRGRGSVSAEFRLAKGGLTPGENVPMNAKVRNQSGRTLRGLELRLSKDVVYKSKTFAGAEQRRTTKNVV

SEQ ID NO: 169075 - protein, 505 aa, Heterodera glycines
  misc_feature (274)..(274): Xaa can be any naturally occurring amino acid
  Homolog annotation: Hit_ID=NP_504752.1; Match level="QueryCoverage =87%, HitCoverage=93%, E-value=7e-47, Identity=30%"; Hit description =ornithine decarboxylase (46.9 kD) (odc-1) [Caenorhabditis elegans] gb|AAB18317.1| Ornithine decarboxylase
  Gene Ontology: Mol. function=enzyme inhibitor activity; Biological process=arginine metabolism
  Coding regions on vcDNA: vcDNA=SeqID_95498; Strand=+; Position=695 -2209
MTNFGFPPSPTFHTVRLREGGTITVFRDVANDEFRRRRPSEFAAQIAESKSAKDDCRPFFVMNIDCAVALLELWAQFLPRVQPFYALNCNADPMLLRLMASHQSVGFSCSSGAEMLNALHYVSADRVFGAFPCWTRSALRQAETCGVYTLCFDSERDLDRILANHSNARLLLRICVDPCATDANALFGAPLDEAVELLKLCVQLGLNCIGISLSTGPSTDDNCNLSSSSLFHFSSVYAFAIECSARLFRIAIDLGLRMDVLNIGDAFACPWSSXSTETDESLAHFAEFCTEFNRSFDVHFPSDGIGHGLRIMATPGQFFARSPFSWVTNVIGKRSTDASAVTNNDFDAGKTAFHYQTNESYYGTFGCRMMVNTEPRCAPLFNDFDMDTEQNQCFYYGTVFGQSGFDDGSDTDIVQSVCHFRQLNIGDWLIWSNMGAYSFGNCGSLDDEINDDDDSDGNEFDTLKTPPIFYFASQGNWESVCHKFDFAFLDEHQQQRRAGPLFASS

SEQ ID NO: 169076 - protein, 100 aa, Heterodera glycines
  Coding regions on vcDNA: vcDNA=SeqID_95499; Strand=+; Position=258-557
KIIGFGISKIVKNERMLIKPSLCQVARDPSGLVFRILIFKKAHFSIFGLGPNDPGAQKRGPKLPRGPKTGAQTRGAKNEGPYALVPNKTPLSARIQKGKK

SEQ ID NO: 169077 - protein, 306 aa, Heterodera glycines
  Homolog annotation: Hit_ID=XP_320889.1; Match level="QueryCoverage =96%, HitCoverage=35%, E-value=1e-43, Identity=32%"; Hit description =ENSANGP00000012033 [Anopheles gambiae] ref|XP_313651.1| ENSANGP00000013044 [Anopheles gambiae] ref|XP_314
  Coding regions on vcDNA: vcDNA=SeqID_95500; Strand=-; Position=1-918
NANSSGKPTRGRPTLPCGSCGKIDHWRSDCSFKDATCFKCNKKGHISTICRSKKKMAPPNSHRSFHSVKVDANCLHVGTTQGRWWKLCILINGRQTSMNGDTGAQATIISLQTWRELGEPELTPSDIDAKNCNDQPFALLGKFQCTVQFADKPPQILIAYVSGEVGHNLLGLPWIEALEIIPRQILFPSSKSADQATMIENFSAVKPPNKSINNVSTLKAVLQKDFPEVFEEGLGHCSKAKAHLILRSDAKRVFCRARPIPHGAMEAVNAELDRLLQIGAIKPIDFSHWAAPILAVKKKNGKTRVC

SEQ ID NO: 169078 - protein, 102 aa, Heterodera glycines
  misc_feature (35)..(35): Xaa can be any naturally occurring amino acid
  Homolog annotation: Hit_ID=NP_741554.1; Match level="QueryCoverage =94%, HitCoverage=19%, E-value=3e-24, Identity=53%"; Hit description =ALDH3C1, ALdehyde deHydrogenase (55.6 kD) (alh-4) [Caenorhabditis elegans] gb|AAM45357.1| Aldehyde dehydr
  Gene Ontology: Mol. function=aldehyde dehydrogenase activity; Cellular component=cytoplasm; Biological process=epidermal differentiation
  Coding regions on vcDNA: vcDNA=SeqID_95501; Strand=+; Position=2-308
VQKDLKRDAKLNYPLEISSVIIEIEYLLHNLERWXQPLNVEKTFTTLLDSPQIVREPKGVVLLIGPWNYPLNTLLMPLVDVLAAGNTAILKPSEVAVEHRRR

SEQ ID NO: 169079 - protein, 247 aa, Heterodera glycines
  Homolog annotation: Hit_ID=CAE56258.1; Match level="QueryCoverage =74%, HitCoverage=78%, E-value=1e-25, Identity=37%"; Hit description =Hypothetical protein CBG23899 [Caenorhabditis briggsae]
  Gene Ontology: Mol. function=chaperone activity; Cellular component =cytoplasm; Biological process=muscle contraction
  Coding regions on vcDNA: vcDNA=SeqID_95502; Strand=+; Position=109-849
MPKQTQNDPMAGAGADLLRDGSDLFSPSGTFNSSLNESTSPIGGSTSSKMSSSFNQSSSYNRTFERKVIEESTPTMTTRMFTSSPLNTIKTTLGSGFPSDLGGLGTGTGTTFVQPHNYQFGTATSGSFHSSDDSLSVSMDCAMFAPEELKVSVVGNQIVVEGKHGEKQDSLGSIERQFVRKFAMPRNATADSVNSNLTSDGMLTVTASAPKAKDNSPIRTIPVKIVTTSAGGQTPQEWGRPISTKWQ

SEQ ID NO: 169080 - protein, 208 aa, Heterodera glycines
  Homolog annotation: Hit_ID=Q27384; Match level="QueryCoverage=89%, HitCoverage=79%, E-value=1e-39, Identity=47%"; Hit description =Pepsin inhibitor Dit33 precursor gb|AAC47103.1| pepsin inhibitor precursor gb|AAA70419.1| aspartyl protease in
  Coding regions on vcDNA: vcDNA=SeqID_95503; Strand=+; Position=43-669
MHFVLIAFCIVWQLVVANNVEQPANRAKRFTSFGSLSTIGGRVGCVVSKNKLFVNGHFTKDLSEDEQEELKQYQEQLDQFKSEVKTYLEERQKQFRNQVARQGGAEAKEGGTQLKKPEPPKKPSFCSDKATTQYVFDGCSVQGDNVYIGDTFVRKLSPDEQKELAQFDQKFTAYQKAVTAGFRKQVEEMFGQHFGRPVRRLRYEPIGC

SEQ ID NO: 169081 - protein, 42 aa, Heterodera glycines
  Coding regions on vcDNA: vcDNA=SeqID_95504; Strand=-; Position=47-175
CNLRFFLEFLEIFTKKLQKVRLKFVFPGDVMFRRNAFQQQHL

SEQ ID NO: 169082 - protein, 157 aa, Heterodera glycines
  Homolog annotation: Hit_ID=CAE75513.1; Match level="QueryCoverage =89%, HitCoverage=30%, E-value=6e-27, Identity=43%"; Hit description =Hypothetical protein CBG23528 [Caenorhabditis briggsae]
  Coding regions on vcDNA: vcDNA=SeqID_95505; Strand=+; Position=79-549
MLERLPSQLVSRSASFVQTRMTANTVNFFMRRTGDTLWKTVTNVSMGGMKRGRARTRQPIRPLPQFYRVGMLKSSPMRIRYPGLNAPIVPQSVAELASRPFFVEEQSEQEREEVLHFVRTQVAKKSSQKRHLCKERLTPLERGFSGGTFMGQRMGPP

SEQ ID NO: 169083 - protein, 182 aa, Heterodera glycines
  Homolog annotation: Hit_ID=NP_510634.1; Match level="QueryCoverage =63%, HitCoverage=35%, E-value=5e-25, Identity=49%"; Hit description =misexpression suppressor of KSR (35.6 kD) (XQ738) [Caenorhabditis elegans] emb|CAA92227.1| Hypothetical p
  Gene Ontology: Cellular component=cytoplasm; Biological process=cell differentiation
  Coding regions on vcDNA: vcDNA=SeqID_95506; Strand=+; Position=8-556
MDKQTFGGDSSANSAAEDKMSGCCSEHIVEIEWKHFDYLSALSGLYTASVERRKCNLLVLVQGNLDNLEGKMVILTIHDVGKNHLSFVDFVNSLSMAPLRGRSLFLHICVPGQEPEAPIFAGSSFPSMDQLGHAMVQVLRHFKISHCFAMGEGAGADICCRFAVTKLFSQIGGPSSRVVQIL

SEQ ID NO: 169084 - protein, 164 aa, Heterodera glycines
  Homolog annotation: Hit_ID=NP_492549.2; Match level="QueryCoverage =91%, HitCoverage=26%, E-value=1e-22, Identity=38%"; Hit description =Arginine-tRNA-protein transferase, N-terminal and Arginine-tRNA -protein transferase, C-terminal family me
  Coding regions on vcDNA: vcDNA=SeqID_95507; Strand=+; Position=51-542
MARQQLNIRRRSVVSYVGISEHGQCGYCKFTKRAHDKAKFAASTSECNASVDASTVASSTNNDGQQQANPPNAHDENANDDTNGGGDSAVFGLWAHRLTVHHYQWLANRGWRRSGRFLYKPLMGRTCCPQYTIRLDVHKFRLSRTQKRVLRTMRDFLRTDQRPK

SEQ ID NO: 169085 - protein, 286 aa, Heterodera glycines
  Homolog annotation: Hit_ID=NP_741348.1; Match level="QueryCoverage =96%, HitCoverage=35%, E-value=1e-113, Identity=66%"; Hit description= ATP-dependent RNA helicase (4D454) [Caenorhabditis elegans]
  Gene Ontology: Mol. function=ATP dependent RNA helicase activity; Cellular component=nucleolus; Biological process=nucleobase, nucleoside, nucleotide and nucleic acid metabolism
  Coding regions on vcDNA: vcDNA=SeqID_95508; Strand=+; Position=33-890
SRHEAEVDFEDEGDYEQLNANQNRKQKKAGGWQSMGLDHSVFKGILRKGYRQPTPIQRKAIPLMCDGRDLVAMSRTGSGKTAAFVVPLLQRLKQRDARGIRALLFSPTRELALQTFKIVKELGRFTGLYCACLIGGDSMDEQFNALHQHPDILIATPGRLLHLVVEMNLKLQTVQFVVFDEADRLFELGFADQLKEILKRIPDSRQTLLFSATLPKMLVDFAKAGLSDPELVRLDVESKLSDKLSMAFALCRQVEKLPVLLNLCRVLCKQKKKTIIFCATMKHVEH

SEQ ID NO: 169086 - protein, 108 aa, Heterodera glycines; identical to SEQ ID NO: 163425
  Coding regions on vcDNA: vcDNA=SeqID_95509; Strand=+; Position=43-369

SEQ ID NO: 169087 - protein, 108 aa, Heterodera glycines
  Coding regions on vcDNA: vcDNA=SeqID_95510; Strand=-; Position=20-346
RSSLVGSGEGDAVDGVTSKWKPNRGSWSSSGDDKLRFNVPLDPIDCCCCCCWSLLPLYFSLVSSPSRFFSGFSSSVENSVIRFAFGPSLSPKFFSLCFSLSNDENLSE

SEQ ID NO: 169088 - protein, 109 aa, Heterodera glycines; identical to SEQ ID NO: 163748
  Coding regions on vcDNA: vcDNA=SeqID_95511; Strand=-; Position=126-455

SEQ ID NO: 169089 - protein, 47 aa, Heterodera glycines
  Coding regions on vcDNA: vcDNA=SeqID_95512; Strand=-; Position=207-350
FLKLHYFIFLAKLIHKYFFRNCSETHQILFISYFRHSDAFTIKKGDE

SEQ ID NO: 169090 - protein, 160 aa, Heterodera glycines
  Homolog annotation: Hit_ID=NP_492693.1; Match level="QueryCoverage =95%, HitCoverage=20%, E-value=8e-09, Identity=27%"; Hit description =CEll Death abnormality CED-12, abnormal cell MIGration MIG-16, ELMO, cell-corpse engulfment and cell migr
  Coding regions on vcDNA: vcDNA=SeqID_95513; Strand=+; Position=1-480
MSNFHLSSKVLNYIDTRPKENEVKGAIKLDVNLRIFIKNERSVEKEKSRKEMATNIYATLDKKEPLAAFIARIGDTLALTEEPENYALMFEEKRRFVTEYNKPSVAQGFFLLLTASPSNFAKHFLAQLGQGSCSAWPHLPLFVSLCADPAFAEAFTALNG

SEQ ID NO: 169091 - protein, 54 aa, Heterodera glycines
  Coding regions on vcDNA: vcDNA=SeqID_95514; Strand=-; Position=205-369
GFRFQTPCHESYQISIYKGTSRSVTRKMHIGYIPLDRQTSIVNFVLGVEKISRS

SEQ ID NO: 169092 - protein, 154 aa, Heterodera glycines
  Coding regions on vcDNA: vcDNA=SeqID_95515; Strand=+; Position=1-462
IAKADFMDERFSRVITANKAYNLFQAAILNGLLTHHLDFIHGKCVDLRKIGLLLDHFDRLVLRSECLLAQNANISLLRCLVKCSFYCRFADFLLCSSIYQQSFNEFRLLAMAMFCYGLALKWACHKSVKGSDGADSALLSLCAAELTTLLRTNL

SEQ ID NO: 169093 - protein, 307 aa, Heterodera glycines
  Homolog annotation: Hit_ID=CAE61649.1; Match level="QueryCoverage =95%, HitCoverage=82%, E-value=9e-78, Identity=52%"; Hit description =Hypothetical protein CBG05583 [Caenorhabditis briggsae]
  Gene Ontology: Mol. function=RNA binding; Cellular component =cytoplasm; Biological process=mRNA splicing
  Coding regions on vcDNA: vcDNA=SeqID_95516; Strand=+; Position=40-960
MSEEKFEDVDGSIIGQKRQNTENGGPASKKANVIESDNLQIKVLIPSAAVGALIGKGGETMRNLKNDSGCRVQMSKNLEVYHGTSERICLVKGKLAATMIVMGAILEKIQEKIDANHASDHFDLKGLDRTKEMKFVVPNTSAGMVIGKNGTSIKEIRDTTTANIQIYPKAGSEEAKISAERVITVGHESNEVLLSAVQRVLEKVVADPMHAQPVPAESQLASGFEFGGSRLSAGSNQFGGISNMGNNSEAMHGKSFGGPSFKFNPLQGTGNNELLAFLDNLQSTLRSSGFNDQSVSEVMQAMQVLAK

SEQ ID NO: 169094 - protein, 97 aa, Heterodera glycines; identical to SEQ ID NO: 166453
  Coding regions on vcDNA: vcDNA=SeqID_95517; Strand=+; Position=203-496

SEQ ID NO: 169095 - protein, 159 aa, Heterodera glycines
  Coding regions on vcDNA: vcDNA=SeqID_95518; Strand=-; Position=0-476
ELAFDAGAEPAPVGQCQLSAFVRQMVDGTVRSDGLGVEHLLTDVAHVQQPGFFVQQMSFAAFMDAVVMEVRPVRCGLFQQTLWAHVKSADIAEMLVAGGRVGAVVRAVSDDAVGVMLLGLHVDKLFFRVGVLLLGHMGPNVMHKHHIVPQFLVATLECA

SEQ ID NO: 169096 - protein, 229 aa, Heterodera glycines
  Homolog annotation: Hit_ID=AAD11968.1; Match level="QueryCoverage =78%, HitCoverage=82%, E-value=5e-38, Identity=40%"; Hit description =P22U [Dirofilaria immitis]
  Coding regions on vcDNA: vcDNA=SeqID_95519; Strand=+; Position=20-709
MRCLFALVPLSCAVLLPFFADAVPPPAAVRSARPAARQAVAAQRQPPAGMERQCKCAEIKPCKDRYQKTMEPCLDTCQSHITSLGGNFRQVKACFTPKESLLNSAMRCTERQHDNACSHSSAAQFVPKRYGQTLENEAMVEIDRMIGRMGLDKSGSMKKLVSVSKKLFGCLKQCMAKRAGNCEKQLKCGLLLPSDSAMVQKTKSCALNNGFNTATAQQTCHCVANAGVK

SEQ ID NO: 169097 - protein, 103 aa, Heterodera glycines; identical to SEQ ID NO: 163890
  misc_feature (10)..(10): Xaa can be any naturally occurring amino acid
  misc_feature (26)..(26): Xaa can be any naturally occurring amino acid
  misc_feature (30)..(30): Xaa can be any naturally occurring amino acid
  misc_feature (45)..(45): Xaa can be any naturally occurring amino acid
  misc_feature (59)..(59): Xaa can be any naturally occurring amino acid
  misc_feature (91)..(91): Xaa can be any naturally occurring amino acid
  Homolog annotation: Hit_ID=AAL78216.1; Match level="QueryCoverage =100%, HitCoverage=30%, E-value=7e-39, Identity=83%"; Hit description= aspartic protease precursor Hgg-33 [Heterodera glycines]
  Coding regions on vcDNA: vcDNA=SeqID_95520; Strand=+; Position=1-312

SEQ ID NO: 169098 - protein, 71 aa, Heterodera glycines
  Coding regions on vcDNA: vcDNA=SeqID_95521; Strand=-; Position=1-213
FLPIFRFLWRAMEPIDRQFCVAIFPDRRSVKQRTVAEGGNFVEEEIVGTPPQVELIKRMFRSHFAICCSIN

SEQ ID NO: 169099 - protein, 144 aa, Heterodera glycines
  Homolog annotation: Hit_ID=AAH86735.1; Match level="QueryCoverage =88%, HitCoverage=13%, E-value=3e-13, Identity=34%"; Hit description =Zgc:101763 [Danio rerio] ref|NP_001008625.1| zgc:101763 [Danio rerio]
  Gene Ontology: Mol. function=structural molecule activity; Cellular component=cilium; Biological process=cilium biogenesis
  Coding regions on vcDNA: vcDNA=SeqID_95522; Strand=+; Position=43-474
MRLRLRLSPWSFRGAVPGVVWVGADEVFSVSDDHSLCRWTVSKTEANFLSNALKDSIFPTSLSAAFPFAAGRSPFSGGLSIRSGKKQQRTSAIHSSQSAGNELILMTASDGKIHLITPAGKIERTIEAHQGAAILARWSTSEPG

SEQ ID NO: 169100 - protein, 213 aa, Heterodera glycines
  misc_feature (83)..(85): Xaa can be any naturally occurring amino acid
  Homolog annotation: Hit_ID=CAI25442.1; Match level="QueryCoverage =79%, HitCoverage=34%, E-value=3e-13, Identity=30%"; Hit description =polymerase (DNA directed), delta 2, regulatory subunit [Mus musculus] gb|AAH03342.1| Polymerase (DNA direc
  Coding regions on vcDNA: vcDNA=SeqID_95523; Strand=+; Position=1-639
VKQQERISFPFSVDSKRFLLLPTDFVDEKSKFFNRQFLTIYRARINCLKDLIKKNARNILASTSNNSVQIDDLSNFSAGNDIXXXGVVFKKMKFRQSILYEFSDDSNVPIKMGRKAGDNLCDDEDILQLEDDQQTVKLLGNIDKHCFVTGDVIGVIGCQEDVSDNFEVRRIIYPEMSPQLEWPLVEHDCYIVFMSGISLVGNFDNDVQTFSAL

SEQ ID NO: 169101 - protein, 110 aa, Heterodera glycines
  Homolog annotation: Hit_ID=XP_315055.1; Match level="QueryCoverage =82%, HitCoverage=11%, E-value=2e-10, Identity=40%"; Hit description =ENSANGP00000011420 [Anopheles gambiae]
  Coding regions on vcDNA: vcDNA=SeqID_95524; Strand=+; Position=572-901
MPKDMSERAKECKEIRKFLLNCVKRTNASATAAAPRVLYISGVPGTGKTAAVLKVQKELCSEKKTPKFDFLNINALELSDPRQLFTKVYGQVQNNCTGTRKKISARNAQQ

SEQ ID NO: 169102 - protein, 59 aa, Heterodera glycines; identical to SEQ ID NO: 166438
  Coding regions on vcDNA: vcDNA=SeqID_95525; Strand=-; Position=102-281

SEQ ID NO: 169103 - protein, 276 aa, Heterodera glycines
  misc_feature (141)..(141): Xaa can be any naturally occurring amino acid
  Homolog annotation: Hit_ID=XP_322018.1; Match level="QueryCoverage =99%, HitCoverage=59%, E-value=1e-114, Identity=67%"; Hit description= ENSANGP00000012089 [Anopheles gambiae]
  Gene Ontology: Mol. function=apoptosis inhibitor activity; Cellular component=cytoplasm; Biological process=chromatin modification
  Coding regions on vcDNA: vcDNA=SeqID_95526; Strand=+; Position=12-837
SRIFYYHHPDLGNFHYGPQHPMKPARLAATHSLVLNYELHKHLTCVHPPKATQHDLARFHAPEYVQFLKRISPLNADQYEGLFNRFNIGEDCPVFDGIFDFCSLYTGGTLEGAIRLNHGQAEIAINWSGGLHHAKKAEASXGFCYVNDIVIGIIELLKCHPRVLYIDIDIHHGDGVQEAFNLTDRVMTVSFHRYGSYFFPGTGDMYDVGMGHGRYFSVNVPLREGMDDESYHSVFKPVIQAVVDNFNPSVIVLQCGADSLGSDRLGCFNLSFDGHG

SEQ ID NO: 169104 - protein, 208 aa, Heterodera glycines
  Homolog annotation: Hit_ID=NP_499246.1; Match level="QueryCoverage =79%, HitCoverage=46%, E-value=1e-43, Identity=50%"; Hit description =blr7445 like (3L204) [Caenorhabditis elegans] emb|CAA87427.2| Hypothetical protein ZK1128.1 [Caenorhabdit
  Gene Ontology: Cellular component=mitochondrion
  Coding regions on vcDNA: vcDNA=SeqID_95527; Strand=+; Position=18-641
MFRNCLLDLTPLRCAFIANKLAHYSSKTPTFSNCIPSPILSGNQLFRIIRDKIRTSGPITVAEYMQICATSQLGYYAGQNEIFGERGDFVTSPELTQIFGELIGSWVVHELEMTSWKDRWQLVELGPGSGELMADVLNVLRQFDVLQNVEVYLVESSERLVERQRETLKKKFGEDLLRTIRWYDSLDDVPQGFSVFLANEFLDALPVH

SEQ ID NO: 169105 - protein, 138 aa, Heterodera glycines
  Homolog annotation: Hit_ID=NP_499055.1; Match level="QueryCoverage =100%, HitCoverage=85%, E-value=4e-61, Identity=74%"; Hit description= protein i-126 (18.5 kD) (3K421) [Caenorhabditis elegans] emb|CAA79557.1| Hypothetical protein C40H1.6 [C
  Coding regions on vcDNA: vcDNA=SeqID_95528; Strand=+; Position=51-464
MDESAKKTLKQIPLLKTNAGPRDGPLWLERLKEEYNSLIAFIEHNKQGDADWFRLESSADGTRWFGKCWTYHNKIKYEFDVEFDVPITYPKTAPEIALPELDGKTAKMYRGGKICLSDHFKPLWARNVPKFGIAHAFS

SEQ ID NO: 169106 - protein, 152 aa, Heterodera glycines
  Homolog annotation: Hit_ID=CAE68714.1; Match level="QueryCoverage =23%, HitCoverage=10%, E-value=4e-09, Identity=77%"; Hit description =Hypothetical protein CBG14639 [Caenorhabditis briggsae]
  Coding regions on vcDNA: vcDNA=SeqID_95529; Strand=+; Position=1-459
EMMFFQLSSSAPTSSSVDGPQQFFQHHHHHHQFVPSISPLFDTSGTGMLGTLAAPTTASIFMPSLFGGCGGAAAGDGTITAAGSLMQSLLSAAVCSGAFPLVGTTVAASPLTATTSQHRKLFIGGLSHETTDEQLRDYYSKWGKVIDCIVIR

SEQ ID NO: 169107 - protein, 161 aa, Heterodera glycines
  Homolog annotation: Hit_ID=CAF98199.1; Match level="QueryCoverage =100%, HitCoverage=27%, E-value=7e-56, Identity=62%"; Hit description= unnamed protein product [Tetraodon nigroviridis]
  Gene Ontology: Mol. function=cystathione beta-synthase activity; Cellular component=cytoplasm; Biological process=cysteine metabolism
  Coding regions on vcDNA: vcDNA=SeqID_95530; Strand=+; Position=3-485
MVKLQRIPAEFGIECNVYGKCEFFNAGGSVKDRIALRMLEIAEQSGRLRAGMTVIEPTSGNTGIGLALACAVKGYHCVIVMPERMSREKELTLKALGAKIVRTKDKARYDSEQSHIGMAFKLRKETPNSVVLDQYKNIANPLTHFEGTAAEILDALDGKVD

SEQ ID NO: 169108 - protein, 193 aa, Heterodera glycines
  Homolog annotation: Hit_ID=NP_740904.1; Match level="QueryCoverage =98%, HitCoverage=40%, E-value=4e-64, Identity=61%"; Hit description =EATing: abnormal pharyngeal pumping EAT-16, regulator of g-protein signaling 7 (54.7 kD) (eat-16) [Caenor
  Gene Ontology: Mol. function=GTPase activator activity; Biological process=regulation of G-protein coupled receptor protein signaling pathway
  Coding regions on vcDNA: vcDNA=SeqID_95531; Strand=+; Position=4-585
MKASETMTNWSEQFQEYDPFITQPHPTNPWVSDDPSLWALNADNVEVPTERRVKRWGLSVMELVRDPIGRQVLESFLDSEFSSENLRFWCCIQDLKFSPNCQVKTKGQHILDEFLAPGAPCQVNVDSRTLEETLRCLEESDQALRNQRFAFSVSEEHVFTLMSKDSYPRFLRSGIYKAVLDAAQGKGWQKTDH

SEQ ID NO: 169109 - protein, 158 aa, Heterodera glycines
  misc_feature (122)..(122): Xaa can be any naturally occurring amino acid
  Homolog annotation: Hit_ID=CAE68867.1; Match level="QueryCoverage =98%, HitCoverage=25%, E-value=6e-54, Identity=61%"; Hit description =Hypothetical protein CBG14830 [Caenorhabditis briggsae]
  Coding regions on vcDNA: vcDNA=SeqID_95532; Strand=+; Position=1-475
VAVDLAAIIVEKNVNSFLSVVDIPKPSLYVYFAFLFALATILWANLLCKSDSNNIFKVHRLMLVLVFLKSLTLLFHGVNFYFVSVYGHERELWAIIYYVTHLLKGALLFGTIILIGSGYTFXKQFLSDRDRRLFIFVLPLQILANIAMIILEESEFSD

SEQ ID NO: 169110 - protein, 124 aa, Heterodera glycines; identical to SEQ ID NO: 163420
  Coding regions on vcDNA: vcDNA=SeqID_95533; Strand=+; Position=13-387

SEQ ID NO: 169111 - protein, 160 aa, Heterodera glycines
  Coding regions on vcDNA: vcDNA=SeqID_95534; Strand=+; Position=1-480
HLSTHYELDQNLFKNKTLREFCAAIHSFYGKCSTNILDHFKKRFNILQFARHLPHFFVGLNSAWIYEFVVLLETTGLNGHILDNDFEMDDNDRFIVNTQLQLLLQEAFRVSWLQNSPFHDKICVSLMRLSPTSDDRLAEHEKRLEHRLKNPPKLELNIVV

SEQ ID NO: 169112 - protein, 404 aa, Heterodera glycines
  Homolog annotation: Hit_ID=AAU91738.1; Match level="QueryCoverage =99%, HitCoverage=77%, E-value=6e-54, Identity=49%"; Hit description =5-methyltetrahydropteroyltriglutamate--homocysteine S -methyltransferase [Methylococcus capsulatus str. Bat
  Gene Ontology: Mol. function=5-methyltetrahydropteroyltriglutamate -homocysteine S-methyltransferase activity; Biological process =cysteine metabolism
  Coding regions on vcDNA: vcDNA=SeqID_95535; Strand=+; Position=13-1224
MKKWFDTNYHFIVPELSTDQSFSVGLNKPLNDFLLAKNALNLVTKPVLVGPVTFLHLSRVGERKELATEEQQKVHNLKLLPSLLPHYVKVVQSLVDAGAKWIQIDEPIFALTFAENEAPAYYDAFRQTARALQQVTAKKAHLLFATYFSSIAKNVQIVKDLPEGTGIHIDLVRAPEQLDPVLSALPANCFVSLGLVDGRNVWLSPLRQCHANALRVVQKLAPGRVLVSSSCSLLHVPYSTKFAQSLTKKPVKGMLTGPMTILKWSFVRNDQPQKDTLFQVALALRDDVAELEKEGINCIQMDEPAFREGLPLDLAQHNEYLKITVQAFKISTGCVADSTQIYSHMCYSDFGDIFTHIAELDADVLCIECSRSDLSLLSCFDRFGYPLMVGPGIYDIHSPRVPSV

SEQ ID NO: 169113 - protein, 79 aa, Heterodera glycines
  Coding regions on vcDNA: vcDNA=SeqID_95536; Strand=+; Position=1-240
HWPLMEDQQGQLRSRRAQTQQTETTVEGPTDNRNGRTGGEETTARTHRNGGPNEASFHGYVTSFRIYVQNFKIRFFEYY

SEQ ID NO: 169114 - protein, 70 aa, Heterodera glycines
  Homolog annotation: Hit_ID=AAL78214.1; Match level="QueryCoverage =65%, HitCoverage=23%, E-value=2e-09, Identity=60%"; Hit description =putative esophageal gland cell protein Hgg-20 [Heterodera glycines]
  Coding regions on vcDNA: vcDNA=SeqID_95537; Strand=+; Position=386-595
MSDHPNVALADLSCVANDVWLDTLFWIDRVEVGTKFALIDARFGKLVATHFNLRKWRLGELGVHRAPSGW

SEQ ID NO: 169115 - protein, 172 aa, Heterodera glycines
  misc_feature (134)..(134): Xaa can be any naturally occurring amino acid
  Homolog annotation: Hit_ID=NP_596868.1; Match level="QueryCoverage =90%, HitCoverage=56%, E-value=3e-18, Identity=31%"; Hit description =RAD1 homolog isoform 1 [Homo sapiens] ref|NP_002844.1| RAD1 homolog isoform 1 [Homo sapiens] gb|AAP35554.
  Gene Ontology: Mol. function=damaged DNA binding; Cellular component =nucleus; Biological process=DNA damage response, signal transduction resulting in induction of apoptosis
  Coding regions on vcDNA: vcDNA=SeqID_95538; Strand=+; Position=88-601
DRAHRQEQQQEKFYSQQQMSEESEEALFCISKHDVKEISQVVKAMAFRDHCTLYVSNEGIRLAVDDQHNQQGSAYFRSEHFQDFNFRTQTCSIKIPMRPLMEALNMFSGTMTMVQISWNGEGFPLLVILEDEGXGVVVHTEIRTLIAPEILEFDFDNENVTAKAILNSLPIR

SEQ ID NO: 169116 - protein, 83 aa, Heterodera glycines
  misc_feature (46)..(46): Xaa can be any naturally occurring amino acid
  Homolog annotation: Hit_ID=NP_730746.1; Match level="QueryCoverage =73%, HitCoverage=7%, E-value=4e-11, Identity=44%"; Hit description =CG11352-PB, isoform B [Drosophila melanogaster] ref|NP_651956.1| CG11352-PC, isoform C [Drosophila melanog
  Coding regions on vcDNA: vcDNA=SeqID_95539; Strand=+; Position=4-255
MAETFSLLSPTHLLNETSLNLRCPYCPKKFLKNTEAISHMDPCLKXRPYPCTNCSRRFKSAQNLSQHERIHTNVRPYNCQEPK

SEQ ID NO: 169117 - protein, 125 aa, Heterodera glycines; identical to SEQ ID NO: 162470
  Coding regions on vcDNA: vcDNA=SeqID_95540; Strand=+; Position=2-379

SEQ ID NO: 169118 - protein, 131 aa, Heterodera glycines
  Homolog annotation: Hit_ID=NP_497100.1; Match level="QueryCoverage =100%, HitCoverage=28%, E-value=2e-13, Identity=34%"; Hit description= human Activating Signal Cointegrator homolog, transcription coactivator functionally similar to its huma
  Gene Ontology: Mol. function=transcriptional activator activity; Biological process=dauer larval development (sensu Nematoda)
  Coding regions on vcDNA: vcDNA=SeqID_95541; Strand=+; Position=1-393
EEKTIIERKDGEGLRLLRCLLDDPNISSVDLSTLSVPKAVSLSAIGKSIETANAYKQKLLKADKDQEVTRVNDLQADYFSLEHNPYLTAAEREAIGNRKEELRQLSLSVKRNILVDLDISTGAMHQQKQKT

SEQ ID NO: 169119 - protein, 133 aa, Heterodera glycines
  misc_feature (63)..(63): Xaa can be any naturally occurring amino acid
  Homolog annotation: Hit_ID=NP_509204.2; Match level="QueryCoverage =98%, HitCoverage=8%, E-value=5e-10, Identity=25%"; Hit description =laminin gamma-1 (XH764) [Caenorhabditis elegans] gb|AAC48152.2| Hypothetical protein C54D1.5 [Caenorhabdit
  Coding regions on vcDNA: vcDNA=SeqID_95542; Strand=+; Position=1-399
AAVIEQQLGQFSTDKETTHKELSVGVNYVQTQGEQHLAKAQEAFDRYGEKSQQLSDIAGESKXLSDRQEQRRREILSLAEQIRKESRQSLSDANEAIFGASSTSLQISALLTEVHELEQRLKAVQQMATEQSL

SEQ ID NO: 169120 - protein, 166 aa, Heterodera glycines
  Coding regions on vcDNA: vcDNA=SeqID_95543; Strand=+; Position=189-689
MSEFTSSDGSGKSVSSKVSESESYDATTLGKLMNLDAKVVEWLEKEPYTDEDPLLVLDFLGPFNNLHGDYNQNKAFLVQKLVAAGGARIAANVDNVIKFATWDMFYEARRILQADLEVRHFFYHPNPAMALQLNINQFPIVSTTVVTFWSDESLKLKTQPYQFFEI

SEQ ID NO: 169121 - protein, 166 aa, Heterodera glycines
  Coding regions on vcDNA: vcDNA=SeqID_95544; Strand=+; Position=136-636
MSEFTSSDGSGKSVSSKVSESESYDATTLGKLMNLDAKVVEWLEKEPYTDDDPLLVLDFLGPFNNLHGDYNQNKAFLVQKLVAAGGARIAANVDNVIKFATWDMFFEARRILQADMEVRHFFYNPNPAIALQNNINQFPIVSTTVVTFWSDDSQKLKTQPCQFFEF

SEQ ID NO: 169122 - protein, 284 aa, Heterodera glycines
  Homolog annotation: Hit_ID=NP_572474.2; Match level="QueryCoverage =81%, HitCoverage=23%, E-value=3e-17, Identity=33%"; Hit description =CG10555-PA [Drosophila melanogaster] gb|AAF46366.1| CG10555-PA [Drosophila melanogaster]
  Coding regions on vcDNA: vcDNA=SeqID_95545; Strand=+; Position=3-917
LKPEQVTVQNLLIENGQLIETVAEYQRMGKIVEATKYQERLHRNLIYLAKLADSTCSSHLLLEIGGAIPPTNESPPPAEPLLTVTNSANPPNIVATIANAGLPHQQQCQPAVSVAIVSQTSPPSGHAQQRGISTTPPAHGVQYQFPSLPQPSPHTQTTQQQQPTTANLHYSQSHQQQANVQLSQQQQQMGTQQHSVVYAGGHAMPTQHHQQYSAAYPLLQQQQQSQQFPPSTGAAFAPMVIPLQNDPIAVGIRQQHQQVYQHTPSHSALQHGTSHAGGYLAQQK

SEQ ID NO: 169123 - protein, 146 aa, Heterodera glycines
  Homolog annotation: Hit_ID=NP_501358.1; Match level="QueryCoverage =86%, HitCoverage=65%, E-value=2e-31, Identity=51%"; Hit description =putative protein of bilaterial origin (21.3 kD) (4I894) [Caenorhabditis elegans] gb|AAB92069.1| Hypotheti
  Coding regions on vcDNA: vcDNA=SeqID_95546; Strand=+; Position=32-469
MNICASKCCLASPIAHRSHSVAFPPFVRRFASHGHDDNKPHPIDDPDIPRQPDMYRPGSDSFAYENPWPMLNKGRLDWLFNDGWRRPLAADQGAHMRRQWIYFKCIPRDEHKDWKKWHGTMPIFGTGCFVMLTFVWQYCNSDWPSA

SEQ ID NO: 169124 - protein, 107 aa, Heterodera glycines
  Coding regions on vcDNA: vcDNA=SeqID_95547; Strand=+; Position=3-326
LSFVERTVQSLLDKKMIVRQEIDMFEATQIGSATFNANFNPQMALDMCNDLGANLGKGIVLISHFHLLYNCVPLDVAVQVDWNLFYNEVIFGAEQRGAAANSFDGFV

SEQ ID NO: 169125 - protein, 108 aa, Heterodera glycines; identical to SEQ ID NO: 147910
  Homolog annotation: Hit_ID=NP_497406.1; Match level="QueryCoverage =96%, HitCoverage=91%, E-value=5e-36, Identity=76%"; Hit description =ATP synthase (12.1 kD) (3C509) [Caenorhabditis elegans] gb|AAK26152.1| Hypothetical protein Y82E9BR.3 [Ca
  Gene Ontology: Mol. function=transporter activity; Cellular component= proton-transporting ATP synthase complex (sensu Eukarya); Biological process=energy pathways
  Coding regions on vcDNA: vcDNA=SeqID_95548; Strand=+; Position=44-370

SEQ ID NO: 169126 - protein, 98 aa, Heterodera glycines
  Coding regions on vcDNA: vcDNA=SeqID_95549; Strand=+; Position=128-424
KIKRQFKQLISLLIFVLFQPKHAAAPAIKITDEANNVYSVCVERDVLPAPENASKDKLKAIAAKCDECGAAKCKAKCGGKEVNDACRTCIMQNCPPAK

SEQ ID NO: 169127 - protein, 111 aa, Heterodera glycines; identical to SEQ ID NO: 163411
  Homolog annotation: Hit_ID=NP_491381.1; Match level="QueryCoverage =82%, HitCoverage=30%, E-value=2e-15, Identity=48%"; Hit description =ribosomal protein L19 (33.7 kD) (1F78) [Caenorhabditis elegans] gb|AAK39323.1| Hypothetical protein Y119C
  Coding regions on vcDNA: vcDNA=SeqID_95550; Strand=+; Position=230-565

SEQ ID NO: 169128 - protein, 197 aa, Heterodera glycines
  Homolog annotation: Hit_ID=NP_956276.1; Match level="QueryCoverage =96%, HitCoverage=21%, E-value=1e-18, Identity=33%"; Hit description =Unknown (protein for MGC:63531) [Danio rerio] gb|AAH61450.1| Unknown (protein for MGC:63531) [Danio rerio
  Gene Ontology: Mol. function=structural constituent of cytoskeleton; Cellular component=cytoskeleton; Biological process=protein targeting
  Coding regions on vcDNA: vcDNA=SeqID_95551; Strand=+; Position=48-641
MASNSNAQLLDACEKGAELKNIKSLIERGANVNFADKDGLSPLMGACVFGNVEIAHCLVELGATIEQKDDEGLTALGHAVIAGQLESVKMLTGKNANCLVFAKDNRSPLVIACQEGRMEILSHFRSVGVNLNHCDEHGITPLMVATQKKRVDVVCFLLQNGADKSQTDAKGRTALAFADDLRDSKERNQLLKLLSDR

SEQ ID NO: 169129 - protein, 235 aa, Heterodera glycines
  Coding regions on vcDNA: vcDNA=SeqID_95552; Strand=-; Position=1-705
AQIGIIKIPEKYFCVRSVELFDECLFGFVPMAAVDNVQKGPIQHTLELKGGVKLFVGNWQQNRRRNRQMVKSRKGMLKETRLNTVVERIRHTTSKRLPPTAMEQSRTAKAKAGGWTTIGNFDVGTLQLAGGKRLVQHLLNRCALPAVHAQLKLQQPMVEAEHRRRTVIVGALSRFICAIARLLLVFFPVKPKEQFHRKQNQRGGVHFAWHWKPFAVGPSKFQCFPRWCRVRVAFD

SEQ ID NO: 169130 - protein, 208 aa, Heterodera glycines
  Homolog annotation: Hit_ID=CAE67634.1; Match level="QueryCoverage =61%, HitCoverage=11%, E-value=9e-09, Identity=30%"; Hit description =Hypothetical protein CBG13191 [Caenorhabditis briggsae]
  Coding regions on vcDNA: vcDNA=SeqID_95553; Strand=+; Position=2-628
LTDAGQLVALTGASGVDRTTLFNTLLNRNLKSLSVEGQLLINAHSLGQFINYASGVFGSSFVVSNILRVLSGFPIVFRIQMADRRRYTPTERMRDMQQNINELIRINRVNAETIQSQAETIRILMGLPGVRQMYDEHQANANQNANQNANQNAPIQNIQYAQPLQIAQAGNFQNLNQLPNLQQNQQQYGQYPFVPTPLGYPPAPQGNP

SEQ ID NO: 169131 - protein, 80 aa, Heterodera glycines; identical to SEQ ID NO: 166423
  Coding regions on vcDNA: vcDNA=SeqID_95554; Strand=-; Position=1-240

SEQ ID NO: 169132 - protein, 229 aa, Heterodera glycines; identical to SEQ ID NO: 163409
  Homolog annotation: Hit_ID=NP_957282.1; Match level="QueryCoverage =100%, HitCoverage=45%, E-value=1e-96, Identity=75%"; Hit description= similar to signal recognition particle 54 kDa [Danio rerio] gb|AAH67588.1| Similar to signal recognition
  Gene Ontology: Mol. function=ATP binding; Cellular component=signal recognition particle; Biological process=signal transduction
  Coding regions on vcDNA: vcDNA=SeqID_95555; Strand=+; Position=1-687

SEQ ID NO: 169133 - protein, 265 aa, Heterodera glycines
  Homolog annotation: Hit_ID=NP_510674.1; Match level="QueryCoverage =70%, HitCoverage=69%, E-value=4e-38, Identity=46%"; Hit description =carbonic anhydrase (28.1 kD) (cah-3) [Caenorhabditis elegans] gb|AAB52498.1| Carbonic anhydrase protein 3
  Gene Ontology: Mol. function=zinc ion binding; Cellular component =mitochondrial matrix; Biological process=one-carbon compound metabolism
  Coding regions on vcDNA: vcDNA=SeqID_95556; Strand=+; Position=43-837
MAATIASHAPQMKQQNVQVAEEETFGKTNGGMPNGAQKQQNGQAKEKQKVGQTAPVARPLTVKDWDYDERGQCGPKHWLRIAKCEHLGDHQSPIDFQLSKMRVHPLNIHPLCLVNFKKPLAGQLINTGCGIQFQPDPQIEPPEIYGGLLDQNYRFVQYHFHWAQNDNEGSEHTIGGLRYPAELHLVHYGVKNPSKLAVLGIFLKLDNESENGEKKKFVFSAEEMEALKKVIEFEQNAAIDTEHSLSSKLPPNCCQEMASSAEHFV

SEQ ID NO: 169134 - protein, 155 aa, Heterodera glycines
  misc_feature (121)..(121): Xaa can be any naturally occurring amino acid
  misc_feature (132)..(132): Xaa can be any naturally occurring amino acid
  misc_feature (139)..(139): Xaa can be any naturally occurring amino acid
  Homolog annotation: Hit_ID=AAK92156.1; Match level="QueryCoverage =95%, HitCoverage=72%, E-value=1e-52, Identity=64%"; Hit description =ribosomal protein L13A [Spodoptera frugiperda] sp|Q962U0|R13A_SPOFR 60S ribosomal protein L13A
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_95557; Strand=+; Position=20-487
MGFSTKPIIIDGKDHLLGRLAAVTSKQLLLGQKIVIVRCESINISGNFHRSKLKFLAFLRKRCNVKPSRGPFHYRAPSRIFWRTVRGMLPHKTARGMEALKKVKCFDGCPQPYDTKKKFVXPISLRHIGLKXGPNYCHXVGRLPPESWWAISRPF

SEQ ID NO: 169135 - protein, 91 aa, Heterodera glycines
  Homolog annotation: Hit_ID=XP_520441.1; Match level="QueryCoverage =79%, HitCoverage=26%, E-value=3e-24, Identity=70%"; Hit description =PREDICTED: similar to Heterogeneous nuclear ribonucleoprotein A1 (Helix-destabilizing protein) (Single-st
  Gene Ontology: Mol. function=heterogeneous nuclear ribonucleoprotein; Cellular component=cytoplasm; Biological process=RNA-nucleus export
  Coding regions on vcDNA: vcDNA=SeqID_95558; Strand=+; Position=203-475
LKENGIDRSHQRSGKSGSLEPEQFRKLFIGGLSLNTTDESLHAFYSQFGMLVDCIVMRDAQTKRSRGFGFVSFQTADEVDAAMSARPHTID

SEQ ID NO: 169136 - protein, 136 aa, Heterodera glycines
  Coding regions on vcDNA: vcDNA=SeqID_95559; Strand=+; Position=169-576
MLQQQSSNNFHHHHHHNLHHQQQLSSSSTFSTSPSAKVPMPPPPLPPPPPFIRRPVVMPTENLSPSNNAPLTNGRGVTSPKKSSSSALRLSFFNGSPLNFFNNSKVVAEKSVPAPPISPPPKAMPSAAETNGLSNG

SEQ ID NO: 169137 - protein, 160 aa, Heterodera glycines
  Coding regions on vcDNA: vcDNA=SeqID_95560; Strand=+; Position=1-480
VQLRSFSAVGRFVKTHKFKNGAQKPPRTAAKKPISGTAREHSAMLCADASRERAVEARVAQGTRAPYVHYQRVQTAVGAVQPFGGLPARGCGQRRGRTVGTTATVPVITVERQWCVCPVVIRSRNGIGHGTDSYGSGRDTVNNGTGGEQSTQTNYNGTAG

SEQ ID NO: 169138 - protein, 131 aa, Heterodera glycines
  Coding regions on vcDNA: vcDNA=SeqID_95561; Strand=+; Position=95-490
LPKMPVRQILSGTRRIATKSLSFGIGSARLADYGVFKALLEPLVVSKFEELSRIRVEKITIFFGILVFVSLADVAMTLRTNEHVGDVERRLESRLEDRFADLRALLERRLDSIDRHLGTSDKATDAKLPGQ

SEQ ID NO: 169139 - protein, 115 aa, Heterodera glycines; identical to SEQ ID NO: 163145
  Homolog annotation: Hit_ID=XP_239780.2; Match level="QueryCoverage =72%, HitCoverage=12%, E-value=3e-18, Identity=53%"; Hit description =similar to RNA helicase A [Rattus norvegicus]
  Gene Ontology: Mol. function=structural constituent of epidermis; Cellular component=intermediate filament; Biological process =epidermal differentiation
  Coding regions on vcDNA: vcDNA=SeqID_95562; Strand=+; Position=39-386

SEQ ID NO: 169140 - protein, 106 aa, Heterodera glycines
  Homolog annotation: Hit_ID=CAE60904.1; Match level="QueryCoverage =90%, HitCoverage=28%, E-value=2e-15, Identity=45%"; Hit description =Hypothetical protein CBG04620 [Caenorhabditis briggsae]
  Gene Ontology: Cellular component=mitochondrion
  Coding regions on vcDNA: vcDNA=SeqID_95563; Strand=+; Position=2-322
SEEGGRIVNVSSSVHLHADSVDPEVVESPRRFGIIATYARSKLANVMHVVALTKRIRTNDSGSKVSANACHPGSVNTELIRNNFFRKYIKKAFAPIIWFVLVSISA

SEQ ID NO: 169141 - protein, 91 aa, Heterodera glycines
  Coding regions on vcDNA: vcDNA=SeqID_95564; Strand=+; Position=72-347
LISSQKSCQLKTAKKAEFSKFFISIFFYSSKFSVIFSRLIEPVKSFRMISRLFDSVNNFKSYIDSKLAGRSWPVPRSAVLVFQIFQRFLFF

SEQ ID NO: 169142 - protein, 51 aa, Heterodera glycines; identical to SEQ ID NO: 166533
  Coding regions on vcDNA: vcDNA=SeqID_95565; Strand=-; Position=180-335

SEQ ID NO: 169143 - protein, 210 aa, Heterodera glycines
  Coding regions on vcDNA: vcDNA=SeqID_95566; Strand=+; Position=1-630
THSLLRRCASHVTSAAIIWCMLGWTMRWGRMPRYRSIGGDANSNWFGGDGAILRTDQQCSARQRLNASAMAKISLRKQCSSFLCCYTQCSTDAPQKCHDDNDAQKAFDAVHLRSLNCFFSSFCPPFRHFLPPKVLLRLCLLFLFAVGGCPIVPGGVSATARSRRTLVPLGMDKQMFPPQIFDENAPICTAEREPCGFYSFSLDGKAPLKW

SEQ ID NO: 169144 - protein, 68 aa, Heterodera glycines
  Coding regions on vcDNA: vcDNA=SeqID_95567; Strand=+; Position=21-224
ICVDGRTHFWSIEYREYVDAYARIYRITLIYHSHVDNVRIKNKYVLMDVRISGALNIVSMWIRTHAST

SEQ ID NO: 169145 - protein, 55 aa, Heterodera glycines
  Coding regions on vcDNA: vcDNA=SeqID_95568; Strand=-; Position=145-312
IFSENSNNMLLMVFEALSTNPASLLANFESRTRIRTSGKLKISTFENIDSAQRIS

SEQ ID NO: 169146 - protein, 214 aa, Heterodera glycines
  Homolog annotation: Hit_ID=CAE60059.1; Match level="QueryCoverage =99%, HitCoverage=35%, E-value=5e-69, Identity=59%"; Hit description =Hypothetical protein CBG03574 [Caenorhabditis briggsae]
  Gene Ontology: Biological process=growth
  Coding regions on vcDNA: vcDNA=SeqID_95569; Strand=+; Position=15-656
MDPYLQELINKWLCWDKNETTRTEIERLVKENNVHELRLRMVGKLSFGTAGVRTHMEAGFARLNELTIIQLSHGMARYLTSEMGEDGKKKGVVIGFDGRHQSKRFAELAANVFVLNGLSAFLFSAVVPTPVVSFAVVSLGCAAGIMITASHNPKEDNGFKAYWANGAQILSPHDTEICRIVAEESKPEEAYWDTVQLGTSAFLHSADSVLEKYF

SEQ ID NO: 169147 - protein, 207 aa, Heterodera glycines
  Coding regions on vcDNA: vcDNA=SeqID_95570; Strand=+; Position=11-631
FHRRHPPQFPSHSIDGTQMARTALSGSATRQRSITDNSNSNCFAVDAAILGTEQQCSARQRMNASAMAKISLQKQCFPPECCYTQCSTDAPQKCHDDNDAQKAFDAVHLRSLNCFFSSFCPPFRHFLPPKVLLRLCLLFLFAVGGCPIVPGGVSATARSRRTLVPLGMDKQMFPPQIFDENAPICTAEREPCGFYSFSLDGKAPLKW

SEQ ID NO: 169148 - protein, 142 aa, Heterodera glycines
  Homolog annotation: Hit_ID=AAH44038.1; Match level="QueryCoverage =98%, HitCoverage=76%, E-value=7e-68, Identity=82%"; Hit description =Ube2h-prov protein [Xenopus laevis] gb|AAH75340.1| MGC89025 protein [Xenopus tropicalis] ref|NP_001004909.
  Gene Ontology: Mol. function=ubiquitin conjugating enzyme activity; Cellular component=cytoplasm; Biological process=protein modification
  Coding regions on vcDNA: vcDNA=SeqID_95571; Strand=+; Position=74-499
MSSPSAGKRRMDTDVLKLIESNHEVVITGGLNEFLVKFYGPKGTAYEGGVWRVRVDLPEKYPFKSPSIGFMNRIYHPNIDEASGTVCLDVINQSWTALYDLSNIFESFLPQLLTYPNPADPLNGEAASLYMHKPDEFKAKCM

SEQ ID NO: 169149 - protein, 202 aa, Heterodera glycines
  misc_feature (73)..(73): Xaa can be any naturally occurring amino acid
  Homolog annotation: Hit_ID=NP_510450.1; Match level="QueryCoverage =92%, HitCoverage=58%, E-value=2e-79, Identity=76%"; Hit description =succinyl-coa synthetase (33.8 kD) (XP373) [Caenorhabditis elegans] emb|CAA94107.1| Hypothetical protein C
  Gene Ontology: Mol. function=succinate-CoA ligase (ADP-forming) activity; Cellular component=mitochondrion; Biological process =succinyl-CoA metabolism
  Coding regions on vcDNA: vcDNA=SeqID_95572; Strand=+; Position=33-638
MSALPSPLLAFATSIRFCTSTRQNLKINQNTKVVVQGFTGKQGTFHGQQMIEYGTNVVAGVSPSKAGTEHLGXPIFATVKDARKKTGADASVIYVPAPFAAAAIDEAIDAEIPLVVCITEGIPQLDMVRVKNRLLKQNRTQLLGPNCPGIIAPGECKIGIMPGHIHEKGVIGIVSRSGTLTYEAVQQTTETGLGQTLCVGIG

SEQ ID NO: 169150 - protein, 98 aa, Heterodera glycines; identical to SEQ ID NO: 162993
  Homolog annotation: Hit_ID=CAE61974.1; Match level="QueryCoverage =93%, HitCoverage=95%, E-value=3e-14, Identity=49%"; Hit description =Hypothetical protein CBG05978 [Caenorhabditis briggsae]
  Coding regions on vcDNA: vcDNA=SeqID_95573; Strand=+; Position=232-528

SEQ ID NO: 169151 - protein, 217 aa, Heterodera glycines
  Homolog annotation: Hit_ID=AAD37247.1; Match level="QueryCoverage =80%, HitCoverage=42%, E-value=2e-10, Identity=34%"; Hit description =chimeric AFGP/trypsinogen-like serine protease precursor [Dissostichus mawsoni]
  Coding regions on vcDNA: vcDNA=SeqID_95574; Strand=-; Position=3-656
ATAAARGLTAAGRRGRRGVAADAELDRATAAGGRRAPAATAAAPVTAARRGRWRGFWAFAANCQLNGTAAAAAAICTITATTTSAAAAAPATAARRGRRRAWGVAANCQFNGTAAATAATSAATAATAAARRLTTAARRGRWRARRVAADAELDRATAAGRRRAPAATALPTETCRVGRNLKAGEKRMGKGRDEKEEKRTFANEGHLDKGKHKLGGK

SEQ ID NO: 169152 - protein, 279 aa, Heterodera glycines
  Homolog annotation: Hit_ID=AAC47437.1; Match level="QueryCoverage =96%, HitCoverage=92%, E-value=1e-115, Identity=66%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_95575; Strand=+; Position=25-864
AFQNPGPGTGTALLAVCLTLPMLKSYVSNVGMKMDSELSSCQHNAKDIWSEVSQLKGLPLLVFCNRTARSAYGSCQECCSGGAQGQPGQPGQPGRPGNPGAPGSPGQPGQTPQTPCEQVHPPPCTPCPGGQPGNNGPPGPPGAPGAPGQPGTGGGQPQPGEPGPPGPNGQPGQPGQPGAPGQPGQPASPPPTEPAPAGPPGEAGAPGQPGQPGAPGQPGAAGQPGPKGPPGGPGQPGNGGAPGQPGQPGQPGNPGERGICPKYCAVDGGVFFEDGTRRR

SEQ ID NO: 169153 - protein, 224 aa, Heterodera glycines
  Coding regions on vcDNA: vcDNA=SeqID_95576; Strand=-; Position=293-967
CVYCIMLYCNEPFTVMWLITVIIDWSLLSLLDENRPFSLGWPQSIGQLAVGVLTGATAAATEAGKRPRNASAKALRAETPAGGHETDNWPTDGLSDGQSADGGQSEGRKSAKDEDVSLASVGVSKFVVVWACLFVPSSVCGIFPILASTRSPMARAWEGLHAGGKADIGGRGEAAEEKRLLFSICAGGSVGSARAPFTGFSRRTNSEFPTHKRRNKSPTEKSNR

SEQ ID NO: 169154 - protein, 157 aa, Heterodera glycines
  Homolog annotation: Hit_ID=CAE66232.1; Match level="QueryCoverage =100%, HitCoverage=51%, E-value=2e-40, Identity=35%"; Hit description= Hypothetical protein CBG11475 [Caenorhabditis briggsae]
  Gene Ontology: Mol. function=protein binding; Cellular component =ubiquitin ligase complex; Biological process=N signaling pathway
  Coding regions on vcDNA: vcDNA=SeqID_95577; Strand=+; Position=3-473
WKLRRPTAVCQLRGHDEHVITCLKLRGDLIVTGSDDCTLRVWSAATGTCVHVLNGHIGGVWALQLSQDGKIAVSGSIKVWDIVAGQCIRTLFGHVAAVRCVKFDGSVIVSGAYDNNIHVWNAADGSLMHVLEGHTNRVYSIHFVSERKLLISGSLDT

SEQ ID NO: 169155 - protein, 279 aa, Heterodera glycines
  Homolog annotation: Hit_ID=NP_741809.1; Match level="QueryCoverage =89%, HitCoverage=92%, E-value=2e-71, Identity=52%"; Hit description =beta Carbonic Anhydrase (30.7 kD) (bca-1) [Caenorhabditis elegans] gb|AAK39291.1| Beta carbonic anhydrase
  Coding regions on vcDNA: vcDNA=SeqID_95578; Strand=+; Position=67-906
MPGIKRLFDGILRFRKTLRPSMVKEFEKVRDHPDPSAMLFTCMDSRLQPSKFMGAQIGELFVVRNSANMVPVAKSFGDSGGEVSVTTEPAALELAIRRGNVRRVVICGHSDCKAINTLYDLYHGRPFDAESPMDHWLRRNGHQSVQKLTQLLMAGPGTELEFASENGLMAFCAHIDRTDQLSAVDKLSQINTLQQLTNIASHEFLREYIVTKKVGLDAMWFDIFNGEIYIFSRMQKLFLPIDEKTSADLLREAIGQIEEENENGGEKRRECRKERHGRT

SEQ ID NO: 169156 - protein, 482 aa, Heterodera glycines
  misc_feature (91)..(91): Xaa can be any naturally occurring amino acid
  Homolog annotation: Hit_ID=NP_299551.1; Match level="QueryCoverage =97%, HitCoverage=60%, E-value=1e-122, Identity=49%"; Hit description= 5-methyltetrahydropteroyltriglutamate--homocysteine methyltransferase [Xylella fastidiosa 9a5c] gb|AAF85
  Gene Ontology: Mol. function=5-methyltetrahydropteroyltriglutamate -homocysteine S-methyltransferase activity; Biological process =cysteine metabolism
  Coding regions on vcDNA: vcDNA=SeqID_95579; Strand=+; Position=3-1449
ALQQVTAKKAHLLFATYFSSIAKNVQIVKDLPEGTGIHIDLVRAPEQLDPVLSALPANCFVSLGLVDGRNVWLSPLRQSCQCVARCAKIGXGRVLVSSSCSLLHVPYSTKTEKRSAEMPKTVATGMASSKIIHWLSFGIEKCEQLVTVAKMINGGDCAKELAENDALLKDHSVSPLIHNGTVKERVTAIEASGVESYFRKSPYEQRIVQQKACLQLPPLPTTTIGSFPQSATVRAMRAKFKAHKMADADYWAFINAETERCIRMQEDIGLDVLVHGEFERNDMVEYFAEHLHGFCVTSNGWVQSYGSRCVKPPVLYGDVQRAGPMTVAMTKFAQSLTKKPVKGMLTGPMTILKWSFVRNDQPQKDTLFQVALALRDDVAELEKEGINCIQMDEPAFREGLPLDPAQHNEYLKITVQAFKISTGCVADSTQIYSHMCYSDFGDIFTHIAELDADVLCIECSRSDLSLLSCFDRFGYPLMVGPG

SEQ ID NO: 169157 - protein, 276 aa, Heterodera glycines
  Homolog annotation: Hit_ID=NP_035286.1; Match level="QueryCoverage =99%, HitCoverage=37%, E-value=6e-82, Identity=54%"; Hit description =prolyl endopeptidase [Mus musculus] gb|AAH12869.1| Prolyl endopeptidase [Mus musculus] gb|AAH50830.2| Pro
  Gene Ontology: Mol. function=prolyl oligopeptidase activity; Cellular component=cytoplasm; Biological process=protein metabolism
  Coding regions on vcDNA: vcDNA=SeqID_95580; Strand=+; Position=1-828
DKLLVCYLEDVKNALYVHSLDDGRELYKLPLPIGSVGGVFAEKSKSKIFVGFESFLVPFILFHGDFSKCPSRESPLQLTETRRVNVPGLDCDAFDSKQVFYPRDDGTKIPMFIVHRKGVKLDGSNPAILNGYGGFNIAQTPYFSVTRLMLAKHFGIVSVIANIRGGSEYGEKWHEAGMLGRKQNVFDDFIAAAEFLISEKYTNNTKLAIHGGSNGGLLTAVCSQQRPDLFGAVVTRVGVLDMFRFNKFTVGAAWTTEYGDPDKPDDFSFIRMYSPL

SEQ ID NO: 169158 - protein, 261 aa, Heterodera glycines; identical to SEQ ID NO: 162427
  Homolog annotation: Hit_ID=NP_001002205.1; Match level="QueryCoverage= 96%, HitCoverage=77%, E-value=1e-70, Identity=57%"; Hit description =dehydrogenase/reductase (SDR family) member 1 [Danio rerio] gb|AAH72703.1| Dehydrogenase/reductase (SD
  Gene Ontology: Cellular component=mitochondrion
  Coding regions on vcDNA: vcDNA=SeqID_95581; Strand=+; Position=23-805

SEQ ID NO: 169159 - protein, 158 aa, Heterodera glycines
  Coding regions on vcDNA: vcDNA=SeqID_95582; Strand=+; Position=2-475
FLTQITCRAKSQAHSMPAFWCHKCRSRCIALERYEDGVRCGRCHEGFIEEIDDIQEDHSQRSASDSPQQTPPPLVLQGHENPFGAFPGSPFARLFQLIHNNIFPTTTAAAGNDGRPTVLIHRRSASEGPSTATHQPQHRQAAATPPPVPMDQQPHTQR

SEQ ID NO: 169160 - protein, 197 aa, Heterodera glycines
  Homolog annotation: Hit_ID=CAE63588.1; Match level="QueryCoverage =93%, HitCoverage=68%, E-value=3e-31, Identity=38%"; Hit description =Hypothetical protein CBG08079 [Caenorhabditis briggsae]
  Coding regions on vcDNA: vcDNA=SeqID_95583; Strand=+; Position=100-690
MPSSVGPSSSSDLLIRLFLLLDSAVHFALGAFLFFCPSTCAHFLLKRPSSDGVHWHLLRCVGGQLMASATLSWRCASPRRLPELRSSCLMLRLLGSVLFVFLFLHIRAVHPDLMPFLVLRQLIWFCFSMIALCVALLIVSGWPIGDKLFAANRWGNVLYQIDTIASISIGMAWVMAPQWLLHRQVRVPMDQSHEFCG

SEQ ID NO: 169161 - protein, 76 aa, Heterodera glycines; identical to SEQ ID NO: 166401
  Coding regions on vcDNA: vcDNA=SeqID_95584; Strand=+; Position=3-233

SEQ ID NO: 169162 - protein, 78 aa, Heterodera glycines; identical to SEQ ID NO: 152412
  Coding regions on vcDNA: vcDNA=SeqID_95585; Strand=+; Position=57-293

SEQ ID NO: 169163 - protein, 127 aa, Heterodera glycines
  Coding regions on vcDNA: vcDNA=SeqID_95586; Strand=+; Position=106-486
MKRTLRKIWICNDVLMDILPFFDHAQLGLKLALISPHFDALVDTHFDGKSDLTIWRRITIWGFGEPKIIVERKSEEFPLPDRPLPSKIHFKDLHIRNICSPVCEFLRSNRHIFDKGINLRLDMDLPA

SEQ ID NO: 169164 - protein, 299 aa, Heterodera glycines
  Homolog annotation: Hit_ID=BAC87096.1; Match level="QueryCoverage =100%, HitCoverage=50%, E-value=2e-57, Identity=43%"; Hit description= unnamed protein product [Homo sapiens]
  Coding regions on vcDNA: vcDNA=SeqID_95587; Strand=+; Position=3-899
HIETHSNGGASVLRCDWRRLKHDLSSQELNEFAEEFIDLGLSELSKVPLFVMCVVEHGIEYLEDLLEYLGTKHSNMPVKMGSLHNKQLVETIQIGHYYEKVISSYKQGTYRCGPLKEITLVGKKQEECGAYFEHLIERLEECPFLRILLPWSERTICSDKRPSESDDGPIYWCRPGEQLIRTDESKFDEIKSKQHRRGSAGTKQTKSAGIPLKALERREILFEDRTPCHADHVTDENKAHTTAAVGLLQAVRSPTEKGKIGDRLVKDVICFHAADFKRVTDILKLDLYEPPMSQCTQWV

SEQ ID NO: 169165 - protein, 78 aa, Heterodera glycines; identical to SEQ ID NO: 166396
  Homolog annotation: Hit_ID=CAB88203.1; Match level="QueryCoverage =100%, HitCoverage=26%, E-value=7e-33, Identity=87%"; Hit description= putative cuticular collagen [Globodera pallida]
  Coding regions on vcDNA: vcDNA=SeqID_95588; Strand=+; Position=6-242

SEQ ID NO: 169166 - protein, 141 aa, Heterodera glycines
  Coding regions on vcDNA: vcDNA=SeqID_95589; Strand=+; Position=42-464
MSHHTQIQQYFCPPSAPAVTYYNYGNITNIDLSPQQAVPQGFQQQVQLTAPAYTVAQYWHNVPSQNGGYQMPQNNGHHAAAYSSGDHPKMGKHKGIGKRFHPQKHQQRASAPHGIRRNGKYSAGATTKQQQANADDTDHQP

SEQ ID NO: 169167 - protein, 131 aa, Heterodera glycines
  Coding regions on vcDNA: vcDNA=SeqID_95590; Strand=-; Position=28-423
IFLFSITFYFIFVDKILFSQAFPCHSSIPFIICFFRFCLRIHAQVGGCWPSSKSLSAFNVSSWHSIFFCAGKQSRREEPIGSSVKHLSWFSMPKYFGGNAATPPTHLSTQPMSKRTQKTNGKLKKDFIFYQ

SEQ ID NO: 169168 - protein, 72 aa, Heterodera glycines
  Coding regions on vcDNA: vcDNA=SeqID_95591; Strand=+; Position=3-221
RINRTKTAWEDAVRSRSNENDKRQLLESIRDRLQNVFEETLKHKAVIEKLEERDKRMGNMLESVDNIENLRK

SEQ ID NO: 169169 - protein, 148 aa, Heterodera glycines
  Homolog annotation: Hit_ID=CAE59330.1; Match level="QueryCoverage =90%, HitCoverage=68%, E-value=2e-24, Identity=53%"; Hit description =Hypothetical protein CBG02672 [Caenorhabditis briggsae]
  Gene Ontology: Mol. function=pre-mRNA splicing factor activity; Cellular component=nuclear speck; Biological process=mRNA splice site selection
  Coding regions on vcDNA: vcDNA=SeqID_95592; Strand=+; Position=36-479
WIPRAAVIRHEGDILIKRGYAFVELDDPRDADDAVYDLNGRSMMGMRVVVEIAKSRPWRSGDSWSSRRRSRSRSRSRGKRSRSRSRSRDRKRRSRSRSLRRRSRSPKRSRSRSVASRSASPPEPKKARHTPSRSRSPDNKRLRSASPR

SEQ ID NO: 169170 - protein, 140 aa, Heterodera glycines
  Homolog annotation: Hit_ID=AAO64256.1; Match level="QueryCoverage =100%, HitCoverage=96%, E-value=4e-67, Identity=88%"; Hit description= putative ribosomal protein S28 [Aspergillus fumigatus]
  Gene Ontology: Cellular component=eukaryotic 48S initiation complex; Biological process=protein biosynthesis
  Coding regions on vcDNA: vcDNA=SeqID_95593; Strand=+; Position=2-424
PRGLNAARSLSNRRRDQRWADKQYKKRALGTAFKSSPFAGASHAKGIVLEKIGVEAKQPNSAIRKCVRVQLIKNGKKITAFVPNDGCLNYIDENDEVLVAGFGRKGRAVGDIPGVRFKVVKVSGVSLLALYKEKKEKPRS

SEQ ID NO: 169171 - protein, 66 aa, Heterodera glycines
  Coding regions on vcDNA: vcDNA=SeqID_95594; Strand=+; Position=3-203
KRVGFKEPHTGLVKNDFFGYWYLQYCLVTGLYMLEPWERKMFNVFVTGFIAVLCSAFYALWNALIN

SEQ ID NO: 169172 - protein, 392 aa, Heterodera glycines
  misc_feature (14)..(14): Xaa can be any naturally occurring amino acid
  Homolog annotation: Hit_ID=NP_498138.2; Match level="QueryCoverage =96%, HitCoverage=80%, E-value=9e-54, Identity=34%"; Hit description =putative cytoplasmic protein of bilaterial origin (50.0 kD) (3G415) [Caenorhabditis elegans] gb|AAA81060.
  Coding regions on vcDNA: vcDNA=SeqID_95595; Strand=+; Position=13-1189
MVISQIAKTLWSHXKKSIFAVIATAYGANALRARLRDDRIRYSFAERARKYGLVSFGPAQRLRRVTVLVNRESGGRRAADLFLRNALPLLNLAGLQVNVVEVSSASELESLCRVLDNSEADCIFLVGGDGTLSRALVGLSQNSAPLPIGLFPGGRKNIAFWRIFQSKNQNRDSMDLNDQDSKSVRMFCESAMALIEGENRLVYPVKCSIAEEMNDSPSDHQTVNTPNTFWLLSDLCAGWFEHCEQKAPKLWWWGPLRYKFVYFWEFLKRKPIPLDLRISYEEFCPGCNRCVTPVKQKNLTTLWSFFSHLLWSSPPDSTKIKVNSDFALVENPNCGQRREANVSGANVRLNVEQTENGSKLKLRVGGAGDAFGRWAAMRFGWNSVGVANGESK

SEQ ID NO: 169173 - protein, 201 aa, Heterodera glycines
  Homolog annotation: Hit_ID=AAT07319.1; Match level="QueryCoverage =82%, HitCoverage=60%, E-value=4e-15, Identity=34%"; Hit description =Sloan-Kettering Institute proto-oncogene product [Anopheles stephensi]
  Gene Ontology: Mol. function=protein binding; Cellular component =transcriptional repressor complex; Biological process=limb morphogenesis
  Coding regions on vcDNA: vcDNA=SeqID_95596; Strand=+; Position=33-635
MLDQTPSTSSTAVTYANLSIDDRDTLMKNLQKLFKTHHQEQNVTNDQQPGSSTSKGTDSRTMKTAARGQTEFPFFTPRDSRYSTLKSTVVDGKALGCFIIGGECRLSFPQMRALCLGEIPTQKIDESMKLLAIVNALATEDQLTVLKRAGLGQPSLSKCELITKTNAERLISLLNSTGTSPIDEVQRSQLHSFRVVHDCFG

SEQ ID NO: 169174 - protein, 152 aa, Heterodera glycines
  Coding regions on vcDNA: vcDNA=SeqID_95597; Strand=-; Position=3-458
LSCANNNFRLNICCRRCCNCCCSSPATSSSSPPFPSRRCSSMPSSPPPVESSQRCCAVAAGAPGISAAAASSSASTSLSSTTALLLLMSCCCWCWFCWEMLSAAGSRENEVCCLINRWKRSGALCPQTLVPNSCSPGDPLVGERPPPRGAPA

SEQ ID NO: 169175 - protein, 159 aa, Heterodera glycines
  Coding regions on vcDNA: vcDNA=SeqID_95598; Strand=+; Position=29-505
AQAQAQAQAPQPTMSSTLPTSSSTGTTTSAAPLPAALLADLTSAIPHSPPPPVTPATLLATRISQPFYASVSTTRRSGTTAAHALALSHVSETAQFVVGYTSRNAPILNDLKGSNAAEVLLSSPPPGTSLARGQVPKVIRIEAKCYLACSPQLLMRFPP

SEQ ID NO: 169176 - protein, 172 aa, Heterodera glycines
  misc_feature (152)..(152): Xaa can be any naturally occurring amino acid
  Homolog annotation: Hit_ID=NP_499240.1; Match level="QueryCoverage =55%, HitCoverage=20%, E-value=7e-29, Identity=69%"; Hit description =speckle-type POZ protein (51.1 kD) (3L182) [Caenorhabditis elegans] emb|CAA83138.2| Hypothetical protein
  Coding regions on vcDNA: vcDNA=SeqID_95599; Strand=+; Position=166-680
MDVDGAAQDEMVTDGPGYIANCPTGSMAQQSSNNGGGSSTSSSSGGGNGAGGNSAVGSSHQQYRSMSPLSGLGMAAASSASGTSSTSSSSSSSSSSVIPLDIGLGMLPIAENWCNTQVKVVKFNYMWTINNFSFCREEMGEVLKSSTFSAGXETKLKRCLGIKPKGLEQESK

SEQ ID NO: 169177 - protein, 97 aa, Heterodera glycines
  Coding regions on vcDNA: vcDNA=SeqID_95600; Strand=-; Position=1-291
ASVFYYQFHPTFPNQQINSFLPFFALLLRFTLSSSPKWAKLVLCSPHFRPFFLCSSVFPFLFFSTDLSRCPFASPPFCWANTQSEPFSRARNVSYSN

SEQ ID NO: 169178 - protein, 158 aa, Heterodera glycines
  Homolog annotation: Hit_ID=CAE72204.1; Match level="QueryCoverage =92%, HitCoverage=23%, E-value=1e-21, Identity=39%"; Hit description =Hypothetical protein CBG19313 [Caenorhabditis briggsae]
  Gene Ontology: Biological process=growth
  Coding regions on vcDNA: vcDNA=SeqID_95601; Strand=+; Position=1-474
QPTNFAFQKSELLRMKEQAEQSGDVARVRDLQQQVNELEEKAKKIEHQRTKNLSAISAINQRNRDHMKQTFLGAGMVREEQEKDDDPFTRKSARMKVVSGSVKSKTAGEGSGANAELSVMDTMVSSLGSLSSSSESSPNKKVQLPSTHDLFNAHGIDI

SEQ ID NO: 169179 - protein, 134 aa, Heterodera glycines; identical to SEQ ID NO: 163384
  Homolog annotation: Hit_ID=NP_495934.1; Match level="QueryCoverage =100%, HitCoverage=100%, E-value=1e-49, Identity=71%"; Hit description=ribosomal Protein, Large subunit (15.5 kD) (rpl-32) [Caenorhabditis elegans] emb|CAA92757.1| Hypothetic
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_95602; Strand=+; Position=58-462

SEQ ID NO: 169180 - protein, 138 aa, Heterodera glycines
  Coding regions on vcDNA: vcDNA=SeqID_95603; Strand=+; Position=1-414
GTDSTNNGHYTDNLNIAAPGVVTQHVCKASNLNQFQLSQINSLHPDTGVVGVYLSTEGTKVLPFVKAAAQGLREMASKPISDELLQACKLLAKGTALTPDEFIALLKTVTADDVKKAASPTLRQSPYLAGEVHQAGPT

SEQ ID NO: 169181 - protein, 107 aa, Heterodera glycines; identical to SEQ ID NO: 163383
  Coding regions on vcDNA: vcDNA=SeqID_95604; Strand=-; Position=6-329

SEQ ID NO: 169182 - protein, 141 aa, Heterodera glycines
  Homolog annotation: Hit_ID=CAE60451.1; Match level="QueryCoverage =90%, HitCoverage=25%, E-value=1e-26, Identity=53%"; Hit description =Hypothetical protein CBG04059 [Caenorhabditis briggsae]
  Gene Ontology: Mol. function=transaminase activity
  Coding regions on vcDNA: vcDNA=SeqID_95605; Strand=+; Position=56-478
MFPRPSTSFPKILNRTKLCQASVVGSNRTMSSSDKLQQQKVLTVDTINPNVITMEYAVRGPIVIRAVELEKQLAKESLPFPSVIRANIGDAHAMGQTPITFIRQVIAGITEPALIKQQPNLFPEDVQRKVASLLRACGGGS

SEQ ID NO: 169183 - protein, 108 aa, Heterodera glycines; identical to SEQ ID NO: 162268
  Homolog annotation: Hit_ID=AAF08341.1; Match level="QueryCoverage =100%, HitCoverage=100%, E-value=8e-42, Identity=73%"; Hit description=peptidyl-prolyl cis-trans isomerase [Brugia malayi]
  Gene Ontology: Mol. function=FK506 binding; Cellular component =membrane; Biological process=transport
  Coding regions on vcDNA: vcDNA=SeqID_95606; Strand=+; Position=58-384

SEQ ID NO: 169184 - protein, 218 aa, Heterodera glycines
  Homolog annotation: Hit_ID=F89530; Match level="QueryCoverage=45%, HitCoverage=28%, E-value=9e-31, Identity=65%"; Hit description =protein H28G03.1 [imported] - Caenorhabditis elegans
  Gene Ontology: Mol. function=heterogeneous nuclear ribonucleoprotein; Cellular component=nucleus; Biological process=RNA processing
  Coding regions on vcDNA: vcDNA=SeqID_95607; Strand=+; Position=1-654
VFQMMFFQLSSSAPTSSSVDGPQQFFQHHHHHHQFVPSISPLFDTSGAGMLGTLAAPTTASIFMPSLFGGCGGAAAGDGTITAAGSLMQSLLSAAVCSGAFPLVGTTVAASPLTATTSQHRKLFIGGLSHETTDEQLRDYYSKWGKVIDCIVIRDPVTRQSRGFGFVTYATIEMADSAMADRPHTIAGKVVDPKRAIPREQMLHATSCPPAFLDVEPP

SEQ ID NO: 169185 - protein, 366 aa, Heterodera glycines
  misc_feature (188)..(188): Xaa can be any naturally occurring amino acid
  misc_feature (215)..(215): Xaa can be any naturally occurring amino acid
  misc_feature (308)..(308): Xaa can be any naturally occurring amino acid
  misc_feature (316)..(316): Xaa can be any naturally occurring amino acid
  misc_feature (328)..(328): Xaa can be any naturally occurring amino acid
  misc_feature (339)..(339): Xaa can be any naturally occurring amino acid
  Homolog annotation: Hit_ID=AAO49799.1; Match level="QueryCoverage =100%, HitCoverage=100%, E-value=0.0, Identity=96%"; Hit description =arginine kinase [Heterodera glycines]
  Gene Ontology: Mol. function=creatine kinase activity; Cellular component=cytoplasm; Biological process=phosphocreatine metabolism
  Coding regions on vcDNA: vcDNA=SeqID_95608; Strand=+; Position=21-1111
MAVPQEVIDKIEAGYKKLQAAADCKSLLKKYLTKDVVDACKDKRTKLGATFLDVIQSGVANLDSGVGVYAPDAEAYTLFKPLFDPIINDYHGGFGPSSKQPATDLGEGKTQLLTDLDPEGKFINSTRVRCGRSLQGYPFNPCLTKENYVEMESKVKAVFEQLKSDAELGGTYYPLQGMTKDVQNQLIXADHFLFKEGDRFLQEANACRYWPTGRXGIFHNAKKTFLVWVNEEDHLRIISMQNGGNVGQVLERLIKGVKAIESKVPFSRDDRLGWLTFCPTNLGTTVRASVHIRLPKISAKPDFKSICXDALKLQIXRGIHGEHSESAXGGVYDISQQGXRLGLTEFEAVKQMYDGVKHLIELEKKA

SEQ ID NO: 169186 - protein, 197 aa, Heterodera glycines
  Homolog annotation: Hit_ID=CAH92373.1; Match level="QueryCoverage =96%, HitCoverage=36%, E-value=1e-52, Identity=51%"; Hit description =hypothetical protein [Pongo pygmaeus]
  Gene Ontology: Mol. function=protein transporter activity; Cellular component=cytosol; Biological process=intracellular protein transport
  Coding regions on vcDNA: vcDNA=SeqID_95609; Strand=+; Position=33-623
MANELISPTPPDIENIFKRLRANPSNKVCFDCGARNPTWSSVTYGVFICIDCSSVHRNLGVHLSFVRSTNLDTNWSWIQLRAMQIGGNANAVAFFKQHGCESNDAQVKYHSKAAAMYKGRIIDLATKAQQQAGSNIFFDALKEQQSPQSKGPNESEFFGSHETEEHTKEMKEASLSEIPHAPIQKTKKITLGQKKGG

SEQ ID NO: 169187 - protein, 188 aa, Heterodera glycines; identical to SEQ ID NO: 163822
  Homolog annotation: Hit_ID=CAE70160.1; Match level="QueryCoverage =66%, HitCoverage=70%, E-value=8e-37, Identity=58%"; Hit description =Hypothetical protein CBG16627 [Caenorhabditis briggsae]
  Gene Ontology: Mol. function=structural constituent of ribosome; Cellular component=mitochondrial small ribosomal subunit; Biological process=protein biosynthesis
  Coding regions on vcDNA: vcDNA=SeqID_95610; Strand=+; Position=9-575

SEQ ID NO: 169188 - protein, 227 aa, Heterodera glycines; identical to SEQ ID NO: 164132
  Coding regions on vcDNA: vcDNA=SeqID_95611; Strand=+; Position=134-814

SEQ ID NO: 169189 - protein, 102 aa, Heterodera glycines
  misc_feature (1)..(1): Xaa can be any naturally occurring amino acid
  Coding regions on vcDNA: vcDNA=SeqID_95612; Strand=-; Position=48-356
XYFESFTENGDRNAFGWNTKTLLFARTELLRLLLLLGANCDPPAFACCGLGFGENLEPATFDWNSFGAGCGDPDFTKMFASKLANVSYFESFSFSYSNRSIG

SEQ ID NO: 169190 - protein, 70 aa, Heterodera glycines
  Coding regions on vcDNA: vcDNA=SeqID_95613; Strand=+; Position=299-511
AYGWYYVRIAPVEQKVWKGFFFDAFVKPVKEQLPHWWMFFFPVVTYFLVTDWAKKEYRRLGRIKEFTDEE

SEQ ID NO: 169191 - protein, 159 aa, Heterodera glycines
  Homolog annotation: Hit_ID=NP_502164.1; Match level="QueryCoverage =88%, HitCoverage=23%, E-value=2e-45, Identity=56%"; Hit description =white family member (67.1 kD) (4M237) [Caenorhabditis elegans] emb|CAB05682.3| Hypothetical protein C10C6
  Gene Ontology: Cellular component=mitochondrion
  Coding regions on vcDNA: vcDNA=SeqID_95614; Strand=+; Position=1-477
AFFHAEVEKRRQCVRERPTPRKTASSWVQTQSLLKRSLIDNWRNPGLTRAKLFQKLIMGVFIGLLYMNTQLNGVGVGNLNGAMFYIIAELTYSTLFGVLTFFPADFPLLAREYHDGLYCSGAYFVARSASYLPLFTIDGILMVTIAYWLIGLVPTVGRF

SEQ ID NO: 169192 - protein, 191 aa, Heterodera glycines
  misc_feature (181)..(181): Xaa can be any naturally occurring amino acid
  Homolog annotation: Hit_ID=CAE63230.1; Match level="QueryCoverage =65%, HitCoverage=26%, E-value=2e-34, Identity=54%"; Hit description =Hypothetical protein CBG07591 [Caenorhabditis briggsae]
  Gene Ontology: Mol. function=tyrosine aminotransferase activity; Biological process=phenylalanine catabolism
  Coding regions on vcDNA: vcDNA=SeqID_95615; Strand=+; Position=61-632
MVSTSPSPPIAMAQHAPLSHRQHRAPLAKVLASEKSLYLSMNAIKTPKKAKMQKVAPIRAQIGDHSEWIPLRASKHSRQTVNPIRRFTDSLSVEPNPNKTPIQLNLGDPTLTGCLPPSESVVAALREAIDSHRFDGYGPAIGTQSAREAIAEHFSCSEAPISANDVVLASGCSHALEMALXAIADPGHNIL

SEQ ID NO: 169193 - protein, 114 aa, Heterodera glycines
  Coding regions on vcDNA: vcDNA=SeqID_95616; Strand=+; Position=52-396
LIMSLLFSLFSSLVSDLLKGLMKLLLFFEQWAGQCQYGAEKTVTFVGVSLRSFVCPSNNRWVSILERRELKTRRNNLLIFSIVLLLWTFQSFCYDSFQISKLSPKILKHKLFSN

SEQ ID NO: 169194 - protein, 177 aa, Heterodera glycines; identical to SEQ ID NO: 163692
  Homolog annotation: Hit_ID=CAE73621.1; Match level="QueryCoverage =94%, HitCoverage=57%, E-value=7e-29, Identity=38%"; Hit description =Hypothetical protein CBG21115 [Caenorhabditis briggsae]
  Gene Ontology: Mol. function=protein binding; Cellular component =basolateral plasma membrane; Biological process=RAS protein signal transduction
  Coding regions on vcDNA: vcDNA=SeqID_95617; Strand=+; Position=86-616

SEQ ID NO: 169195 - protein, 70 aa, Heterodera glycines; identical to SEQ ID NO: 143743
  Homolog annotation: Hit_ID=CAE69217.1; Match level="QueryCoverage =97%, HitCoverage=94%, E-value=1e-15, Identity=54%"; Hit description =Hypothetical protein CBG15257 [Caenorhabditis briggsae]
  Coding regions on vcDNA: vcDNA=SeqID_95618; Strand=+; Position=25-237

SEQ ID NO: 169196 - protein, 94 aa, Heterodera glycines; identical to SEQ ID NO: 163378
  Coding regions on vcDNA: vcDNA=SeqID_95619; Strand=-; Position=34-318

SEQ ID NO: 169197 - protein, 141 aa, Heterodera glycines; identical to SEQ ID NO: 161711
  Homolog annotation: Hit_ID=AAH80970.1; Match level="QueryCoverage =96%, HitCoverage=93%, E-value=5e-28, Identity=46%"; Hit description =MGC79746 protein [Xenopus tropicalis] ref|NP_001008076.1| MGC79746 protein [Xenopus tropicalis]
  Gene Ontology: Cellular component=TRAPP; Biological process =intracellular protein transport
  Coding regions on vcDNA: vcDNA=SeqID_95620; Strand=+; Position=121-546

SEQ ID NO: 169198 - protein, 180 aa, Heterodera glycines
  Homolog annotation: Hit_ID=NP_500802.1; Match level="QueryCoverage =100%, HitCoverage=97%, E-value=6e-47, Identity=51%"; Hit description= putative protein of eukaryotic origin (4G158) [Caenorhabditis elegans] gb|AAF60946.1| Hypothetical prote
  Coding regions on vcDNA: vcDNA=SeqID_95621; Strand=+; Position=43-585
MNKWRLDLCGSAGSRTLMLRSAAADQSLNPPGYNPGLSTTQQNESANRAEQQQQHLLSKRAWDLALQPVKSLPMNMLPFRFMMYMAGNTISIFPIMMVVMMAWRPMKTLMSVNAAFKPLEQEHVGSLWIHKIVFALGNLCAIALAVYKCHTMGLLPNHASDWLDFVPPLERAQYALFNDI

SEQ ID NO: 169199 - protein, 101 aa, Heterodera glycines
  Coding regions on vcDNA: vcDNA=SeqID_95622; Strand=+; Position=89-394
KKKRKKERKKLQTYESVEAKFDLQKIEKMSTLTNRLNKLADHLGEIGHLHFEKGDLNAMDLEEKPMFEIVRLAEQKQHEIEEGRRNGKSKAEKVTEAMANE

SEQ ID NO: 169200 - protein, 299 aa, Heterodera glycines
  Homolog annotation: Hit_ID=AAL78214.1; Match level="QueryCoverage =51%, HitCoverage=78%, E-value=9e-10, Identity=28%"; Hit description =putative esophageal gland cell protein Hgg-20 [Heterodera glycines]
  Coding regions on vcDNA: vcDNA=SeqID_95623; Strand=+; Position=87-983
MNRRWICGDVWMDILPSFDRPELGLKMALLSDRFDVLVDTHFDGKNELTIWRTINISKDKGPKAKLSVEIGAKFVAFPLPNHSLPNKICFKDLRIDYIDHSVFAFLRSNKPIWDRMGTKLEVFVHAIDTDVQPIWDVFVREIWPIFATNIRHLSFAGADALDNLRRRISPTLLTDLVQLYSITSYGLCPDGISDDGPNATAGQALSKWLHTPSKNGKANELYCCAYFCEITWINTFKETFLRATTSVAYNVRLELLVANEMNTVEQFELVNEMTQEKLTLTKDEEICLLKRCPIVGETA

SEQ ID NO: 169201 - protein, 210 aa, Heterodera glycines
  misc_feature (132)..(132): Xaa can be any naturally occurring amino acid
  Homolog annotation: Hit_ID=NP_494780.1; Match level="QueryCoverage =93%, HitCoverage=56%, E-value=8e-40, Identity=49%"; Hit description =nucleotidase (2E711) [Caenorhabditis elegans] gb|AAA83579.1| Hypothetical protein ZK430.2 [Caenorhabditis
  Gene Ontology: Cellular component=mitochondrion
  Coding regions on vcDNA: vcDNA=SeqID_95624; Strand=+; Position=53-725
MTSEKEMLWDKACLLTRLVASSVRLSEAAGGIIKDIMKSGDLKIVNKDQTGQMKDLQTEADRSAQICIERSLHIAPPSTPFQTLQPLPSSHHFHIIFNENATTAVPSSEVLSNDERVPNELRSIEMKDVVVXVDPLDGTSEFTKSKENPALLRQVTVLIGITHKGRPVAGIVHQPYYEGQQTADGLAPNGRTIWSIVGVGTFGHQKTAQQ

SEQ ID NO: 169202 - protein, 74 aa, Heterodera glycines
  Coding regions on vcDNA: vcDNA=SeqID_95625; Strand=+; Position=141-365
MSNPIKIVRIVEIIEADEAAGQPKQVVAEYVDGTGRRVTMKASGEVRIGQLVAFFEGPDRNRIQRCFTNNNNNN

SEQ ID NO: 169203 - protein, 152 aa, Heterodera glycines
  Coding regions on vcDNA: vcDNA=SeqID_95626; Strand=-; Position=4-462
FEHALFLFVFPNIKHTFEIRLSVTDLFAITSLHLTIVFLSLSSLVLLLELELGSKERNAESARQIKKSADEPTPTFDLHERRKVVRPSVTDWAGRCCRLPIGDFHGFGVVNAGSAGQMHRAHRTRRNGDNKTFEKHLSRKCHKNSAKKDGEF

SEQ ID NO: 169204 - protein, 141 aa, Heterodera glycines
  Coding regions on vcDNA: vcDNA=SeqID_95627; Strand=-; Position=1-423
NIQKENDFVLISLFLGIERPVFCLDWHGTFTAFHLLPNRLQKLPESPPAPRAADSHCLRCRGAMPTALAEPMPGAASGTTPWALSRGAQEAEGKMIRAMAAATSSRKANIEGNEGRHILLIGRRDILLWIFNDKIRTKIIS

SEQ ID NO: 169205 - protein, 158 aa, Heterodera glycines
  Homolog annotation: Hit_ID=XP_319513.1; Match level="QueryCoverage =97%, HitCoverage=45%, E-value=7e-29, Identity=43%"; Hit description =ENSANGP00000002045 [Anopheles gambiae]
  Gene Ontology: Mol. function=deoxyribonuclease II activity; Cellular component=lysosome; Biological process=DNA metabolism
  Coding regions on vcDNA: vcDNA=SeqID_95628; Strand=+; Position=3-476
LVHSVPKFPASTGADYLYPQSGKRNGQSMLCITLSSTALKEIGQQLFVAQPNVYDFQLPDSFARLFPDLAKAVNRTTFPYKKRVPFSVTDVHSLKGQSFTTFHKHKQFGKDLYSELVAPRLKSSIYVETWLVGRGDLPSDCSSSFKVHNVLSVKASKF

SEQ ID NO: 169206 - protein, 156 aa, Heterodera glycines
  Coding regions on vcDNA: vcDNA=SeqID_95629; Strand=+; Position=7-474
EKNFCDAKGLMRFSPRIFPSFLQQLINRNFLALHCPLPATSAAKFSTDGKSDVFCASLLHNELCEKLDKRKEEWRKQRPGTKEYTATKEQLNQLQEEIIKIENSKYEFLHTERDKMSIANLVLAPTQVTLEVISNGTTHLRPSVVLRTPLNAYLFN

SEQ ID NO: 169207 - protein, 112 aa, Heterodera glycines; identical to SEQ ID NO: 163372
  Homolog annotation: Hit_ID=NP_741567.1; Match level="QueryCoverage =98%, HitCoverage=10%, E-value=3e-32, Identity=54%"; Hit description =IMportin Beta (123.9 kD) (imb-4) [Caenorhabditis elegans] gb|AAB04981.2| Importin beta family protein 4,
  Gene Ontology: Cellular component=cytoplasm
  Coding regions on vcDNA: vcDNA=SeqID_95630; Strand=+; Position=3-341

SEQ ID NO: 169208 - protein, 158 aa, Heterodera glycines
  Coding regions on vcDNA: vcDNA=SeqID_95631; Strand=+; Position=3-476
RNLSLLLPYFSSSSVQFEMSKHFLFLALLFFVGQISAKSIHSKSEEKEDPFFGEETDGTEEPQETDEPKPYGWENIYEKCMDQFDDHKKCCEVSGGGDECLLEDTTTEAGETTTEEPEYSDETFKKCMAKLNQSKDNCCFIFEDKKLKECEHWQPQTT

SEQ ID NO: 169209 - protein, 195 aa, Heterodera glycines; identical to SEQ ID NO: 163371
  Homolog annotation: Hit_ID=NP_498174.1; Match level="QueryCoverage =72%, HitCoverage=83%, E-value=4e-21, Identity=38%"; Hit description =immature colon carcinoma transcript 1 like (3G589) [Caenorhabditis elegans] gb|AAL06045.1| Hypothetical p
  Coding regions on vcDNA: vcDNA=SeqID_95632; Strand=+; Position=90-674

SEQ ID NO: 169210 - protein, 89 aa, Heterodera glycines
  Coding regions on vcDNA: vcDNA=SeqID_95633; Strand=-; Position=0-266
MKETNYNLSISSKILEALRHVFLDRPSAAHPSEFALCLSRQGAQIRIILNTVQHINATVVVEFKDECWSRSLLFLINTTDQLLSIGGSG

SEQ ID NO: 169211 - protein, 227 aa, Heterodera glycines
  Homolog annotation: Hit_ID=NP_082497.2; Match level="QueryCoverage =95%, HitCoverage=86%, E-value=3e-22, Identity=36%"; Hit description =RIKEN cDNA 2310065K24 [Mus musculus] gb|AAH25472.1| RIKEN cDNA 2310065K24 [Mus musculus] gb|AAH23158.1| R
  Coding regions on vcDNA: vcDNA=SeqID_95634; Strand=+; Position=1-681
PRAEFGTRNFVSEEELQKQREAGEEKPESSEPVDKRTLYERLKEQKDIKQLEYDETHALKNQFRGIDEAESDFLTQVERAKEEQEARKRKEEQELVRLSRQLTQQHATGATAEQQQHALLEKPQKASTAASSGISRQAALITSLVRRKRPLSTDSEPKSARGEVPSPPSSSDSDKRKTNEPSKASGGPPPKQRHESHCQIIGVLPGLPNYSDSSDEAESSNNSESLE

SEQ ID NO: 169212 - protein, 82 aa, Heterodera glycines; identical to SEQ ID NO: 163370
  Coding regions on vcDNA: vcDNA=SeqID_95635; Strand=+; Position=3-251

SEQ ID NO: 169213 - protein, 306 aa, Heterodera glycines
  Homolog annotation: Hit_ID=NP_003163.1; Match level="QueryCoverage =84%, HitCoverage=87%, E-value=3e-44, Identity=38%"; Hit description =surfeit 1 [Homo sapiens] emb|CAI12837.1| surfeit 1 [Homo sapiens] gb|AAH71658.1| Surfeit 1 [Homo sapiens]
  Gene Ontology: Mol. function=heme transporter activity; Cellular component=mitochondrial inner membrane; Biological process=electron transport
  Coding regions on vcDNA: vcDNA=SeqID_95636; Strand=+; Position=10-930
MLTHRKYRLLQFASVSGRALTISPEFRQLSSVSSIPSNSHKTSKSDGKAPKSSTLWLNLPSNAEEDVRTRVRSSFFGTYVALLFPAATFALGCWQWKRHKWKTELIEKLKIATKTAPVEFPVDNLSAIDDMEFRKVHVRGYYLFDRQFVIRWRCRLDPANTGTSNSEKYGAYVITPMRLEGTNVTIMVNRGWVPNENIESELKKGKQLRESELKDLNAVVRSAEKGSPFVKNDPEKGIWAFKDLEEMARQSDAVPIIVDADFESTEKDGPIGGQTIVVLRNQHYSYMVQWFGLTVGVLGMWALRFL

SEQ ID NO: 169214 - protein, 190 aa, Heterodera glycines
  Coding regions on vcDNA: vcDNA=SeqID_95637; Strand=+; Position=21-590
MANFPPNSDEEFDRGNFSSLSGMVGMNQRHLDWLMKNISREDMAELQQRTGQCARKCAVTYGGPIVVVTIGFLEFLRRKQNLPITAPRFLIGYPIMCLTSVALGSSIGFKRSGCGAEMRLFLDKLYAKYDSQMNAASAQMAPGVGGGTSPTKTYAQLREANRAGRPIELGQLKQQQTRQQQKKMDGSKAT

SEQ ID NO: 169215 - protein, 155 aa, Heterodera glycines
  Coding regions on vcDNA: vcDNA=SeqID_95638; Strand=+; Position=8-472
MSPKQFKLTHSLFSFQRISQADGVKRKQMKADESICPPQRKKPSTSLKEADGSDGAVENVQTKENMRPILEAERHQQNDDGTGEIRSPPSSSPTPWHPSHALAEPTWQKLLRKEFQMKYMTNICCFLEEQAKQGVSVFPPRHLIFNAFNLTPFNN

SEQ ID NO: 169216 - protein, 202 aa, Heterodera glycines
  Homolog annotation: Hit_ID=NP_740982.1; Match level="QueryCoverage =75%, HitCoverage=31%, E-value=3e-75, Identity=85%"; Hit description =k+ channel tetramerisation containing protein (54.1 kD) (2F201) [Caenorhabditis elegans] gb|AAA83172.1| H
  Coding regions on vcDNA: vcDNA=SeqID_95639; Strand=+; Position=1-606
GLQVSKTRGIILPQLVISAERGERECHIVVLLDEDVVDWDEEYPPQMGEDVTQVVYSTPLYKFFKYAENRDVAKRVMKDRELKKIRLGIEGYPTHKEKIKRRFNRSEVVYNYVQRPFLHCSWEKEEARSRHVDFACPIVKSKSNPSLASAASDPLPQPAPLQNNINNGWAAENGAGEHSANFQQRPTNDNDGSSGNENEAVH

SEQ ID NO: 169217 - protein, 106 aa, Heterodera glycines
  Homolog annotation: Hit_ID=NP_496446.2; Match level="QueryCoverage =87%, HitCoverage=15%, E-value=7e-28, Identity=58%"; Hit description =kinesin-like protein (67.9 kD) (klp-17C) [Caenorhabditis elegans] dbj|BAA92262.1| kinesin like protein [C
  Gene Ontology: Cellular component=extracellular space
  Coding regions on vcDNA: vcDNA=SeqID_95640; Strand=+; Position=1-321
GTQLALFDRSNISFAVSFLAGGLAIGYLLGWRTAASKLARCNTRVQLSKDKVVDTVELEDIGEKKAYCRCWQSKKFPLCDGSHNEHNKKTGDNVGPLIVPKAKSAS

SEQ ID NO: 169218 - protein, 146 aa, Heterodera glycines
  Homolog annotation: Hit_ID=NP_082438.2; Match level="QueryCoverage =80%, HitCoverage=14%, E-value=1e-11, Identity=35%"; Hit description =TBC1 domain family, member 5 [Mus musculus] gb|AAH43113.1| TBC1 domain family, member 5 [Mus musculus]
  Coding regions on vcDNA: vcDNA=SeqID_95641; Strand=+; Position=36-473
MEEQGPFLIDWRTLFGKAPFELRKQCIRGHLRNSHLRSIVWRLLLGVLPMEDRTQWVEVIGQERRNYTELRHRIESNPRINNSPEGKNFDGNNPLSLNAESPWCRHFENQSTRKNIEKDVDRTCLKSSKQCLRQLHITVQSAEEAK

SEQ ID NO: 169219 - protein, 137 aa, Heterodera glycines
  Homolog annotation: Hit_ID=NP_996512.1; Match level="QueryCoverage =86%, HitCoverage=30%, E-value=2e-28, Identity=55%"; Hit description =CG33253-PA [Drosophila melanogaster] gb|AAS65408.1| CG33253-PA [Drosophila melanogaster] gb|AAM29428.1| R
  Gene Ontology: Mol. function=protein binding; Cellular component =integral to membrane; Biological process=signal transduction
  Coding regions on vcDNA: vcDNA=SeqID_95642; Strand=+; Position=32-445
MSSENPPSPMQRQQSSVQLQQSSVSDMGDPDDCFSMFLVFMSYVLLFFTFPCTIFSCIKIVQQYERAVIFRLGRIRRKAQGPGLFFILPCVDEYRCVDLRTVTCDVPPQQVLSKDSVTVTVDAVGFLSWTNNRRFCI

SEQ ID NO: 169220 - protein, 98 aa, Heterodera glycines; identical to SEQ ID NO: 163711
  Coding regions on vcDNA: vcDNA=SeqID_95643; Strand=+; Position=57-353

SEQ ID NO: 169221 - protein, 297 aa, Heterodera glycines; identical to SEQ ID NO: 162552
  Homolog annotation: Hit_ID=AAM18623.1; Match level="QueryCoverage =100%, HitCoverage=95%, E-value=1e-177, Identity=79%"; Hit description=C-type lectin domain protein [Heterodera glycines]
  Coding regions on vcDNA: vcDNA=SeqID_95644; Strand=+; Position=3-896

SEQ ID NO: 169222 - protein, 111 aa, Heterodera glycines
  Coding regions on vcDNA: vcDNA=SeqID_95645; Strand=-; Position=199-534
SVRGAPRFCPAKHRSHPSSKCSVARLSSAEVPRPLRKNSPSATEGSQRRNVRLFVAFFCCCCCPMQRELMADNGSGGFGCRSHWPTLAKRSAERRGGKGSSGRRRTFATSV

SEQ ID NO: 169223 - protein, 86 aa, Heterodera glycines; identical to SEQ ID NO: 166346
  Coding regions on vcDNA: vcDNA=SeqID_95646; Strand=+; Position=20-280

SEQ ID NO: 169224 - protein, 42 aa, Heterodera glycines; identical to SEQ ID NO: 166345
  Coding regions on vcDNA: vcDNA=SeqID_95647; Strand=+; Position=1-129

SEQ ID NO: 169225 - protein, 280 aa, Heterodera glycines
  Homolog annotation: Hit_ID=NP_499001.1; Match level="QueryCoverage =95%, HitCoverage=85%, E-value=3e-51, Identity=41%"; Hit description =putative cytoplasmic protein of ancient origin (3K134) [Caenorhabditis elegans] emb|CAA78469.2| Hypotheti
  Coding regions on vcDNA: vcDNA=SeqID_95648; Strand=+; Position=42-916
MSPIDPDKMALLKRLFPVLGKHLRKGDCGKIGVIGGSPDYTGAPYFASITPMKIGADLAFVYAHSDAAPVIKSYSPELIVYPSTDFATNRHSIERLDALVFGPGLGRQKHTQNLLADVVNFVRSKQNLCLVIDADGLFFVKECSQLFKGCTDKVIITPNHREFVRLYTQMFPNQQKGEDTDELKIQCEMAEQLAKHLEVTVMRKGEIDIISNGSSQTRIVQAETSMRRCGGQGDILSGATALFAFWARKASDADIYSSEHLLDGAEAASLLVRNASLRTF

SEQ ID NO: 169226 - protein, 165 aa, Heterodera glycines; identical to SEQ ID NO: 163308
  Coding regions on vcDNA: vcDNA=SeqID_95649; Strand=+; Position=192-686

SEQ ID NO: 169227 - protein, 67 aa, Heterodera glycines
  Coding regions on vcDNA: vcDNA=SeqID_95650; Strand=+; Position=69-272
MSMTWPKYLGSYITLQNAFRMTLAALIPAVAKMYEDSEVARLTRFRDRSAMFGRPPPPPGVEEIPSW

SEQ ID NO: 169228 - protein, 93 aa, Heterodera glycines
  Coding regions on vcDNA: vcDNA=SeqID_95651; Strand=-; Position=130-411
IFKKESVRTNKTITKSSIRLLLFIFAWIICFLFQFTCALRFPPCHTTQAHIEHRCLNRHSFGGFWRSARFDILILNAYHLKSVRKIRPKKQKR

SEQ ID NO: 169229 - protein, 112 aa, Heterodera glycines; identical to SEQ ID NO: 163356
  Coding regions on vcDNA: vcDNA=SeqID_95652; Strand=-; Position=141-479

SEQ ID NO: 169230 - protein, 581 aa, Heterodera glycines
  misc_feature (457)..(457): Xaa can be any naturally occurring amino acid
  misc_feature (562)..(562): Xaa can be any naturally occurring amino acid
  Homolog annotation: Hit_ID=NP_492457.1; Match level="QueryCoverage =99%, HitCoverage=67%, E-value=0.0, Identity=83%"; Hit description =translation Elongation FacTor (94.8 kD) (eft-2) [Caenorhabditis elegans] emb|CAB02985.1| Hypothetical prote
  Gene Ontology: Mol. function=translation elongation factor activity; Biological process=protein biosynthesis
  Coding regions on vcDNA: vcDNA=SeqID_95653; Strand=+; Position=3-1746
NQEPVTKRGFCQFVLDPIFKVFDAVMNIKKDEVAKLVEKLNIKLTLEEKEQEGKPLLKTMMRKWLPAGDTMLQMIVMHLPSPVTAQRYRMEMLYEGPHDDEAAVAMKNCDPNGPLMMYISKMVPTSDKGRFYAFGRVFAGRVATGMKARIQGPNYVVGKKEDLYEKTIQRTILMMGRYIEPIEDIPAGNIAGLVGVDQYLVKGGTITTYKDAHNMRVMKFSVSPVVRVAVEPKNAGDLPKLVEGLKRLAKSDPMVQCIFEESGEHIIAGAGELHLEICLKDLEEDHACIPLKKSDPVVSYRETVTEESEIVCLSKSPNKHNRLFCKARPLPDGLPEAIERGDVNPTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQIIPTARRVFYASVLTXAKPRLLEPVYLVEIQCPEAAVGGIYGMPKPPPWGPPWRKNKMLGTPMFIVKAHLPVNESFGFTADLRSNTGGQAFPQCVFDHWQVLPGDPFDGTSRPGQVVTETXKRKGLKEGIPSLDNFYDKL

SEQ ID NO: 169231 - protein, 99 aa, Heterodera glycines; identical to SEQ ID NO: 166341
  Coding regions on vcDNA: vcDNA=SeqID_95654; Strand=-; Position=2-298

SEQ ID NO: 169232 - protein, 50 aa, Heterodera glycines; identical to SEQ ID NO: 166340
  Coding regions on vcDNA: vcDNA=SeqID_95655; Strand=+; Position=1-153

SEQ ID NO: 169233 - protein, 206 aa, Heterodera glycines
  Homolog annotation: Hit_ID=NP_492692.1; Match level="QueryCoverage =82%, HitCoverage=81%, E-value=2e-36, Identity=45%"; Hit description =5-formyltetrahydrofolate cyclo-ligase (1K796) [Caenorhabditis elegans] emb|CAA21728.1| Hypothetical prote
  Gene Ontology: Mol. function=5-formyltetrahydrofolate cyclo-ligase activity; Cellular component=cytosol; Biological process=formate metabolism
  Coding regions on vcDNA: vcDNA=SeqID_95656; Strand=+; Position=18-635
MMSNAATPKLAKKVLRKKIGEIIAQQMAGENGGNIRERETATVAQKLLVNEWFRNSTRLSIYVSNEQEICTDDIVRTALREGKEVFIPRFKKGAERMEMLRLESEKEFDSLEGTLWGIRQHSASLSPPSFEETSAKAPLDLVVMPGVAFTTSGKRLGHGRGFYDRFLNEYAQKYGTVPRTIALALKVQLVDDLPMESKDRMVDEVI

SEQ ID NO: 169234 - protein, 155 aa, Heterodera glycines
  Homolog annotation: Hit_ID=XP_421796.1; Match level="QueryCoverage =60%, HitCoverage=15%, E-value=1e-26, Identity=56%"; Hit description =PREDICTED: similar to arginine-tRNA-protein transferase 1-2p; ATE1 -2p [Gallus gallus]
  Gene Ontology: Mol. function=arginyltransferase activity; Cellular component=cytoplasm; Biological process=RNA processing
  Coding regions on vcDNA: vcDNA=SeqID_95657; Strand=+; Position=3-467
AKYFFYDPDFAFLSLGTYSALREIAFTQQLAQHRPDLHFYYMGFYLFDCPKMRYKNRFRPSELLCDHCFNWVPVTECDRILEANGGRFSTFHPSAEPTRAELDSAQMDQILCLHGDPPRPLTFASLCNSLETAAAHPSSSTDSQRQNGRGEGPEM

SEQ ID NO: 169235 - protein, 202 aa, Heterodera glycines
  misc_feature (152)..(152): Xaa can be any naturally occurring amino acid
  Homolog annotation: Hit_ID=NP_500214.1; Match level="QueryCoverage =94%, HitCoverage=60%, E-value=1e-57, Identity=61%"; Hit description =ATP synthase mitochondrial (32.4 kD) (4D261) [Caenorhabditis elegans] gb|AAK68562.1| Hypothetical protein
  Gene Ontology: Mol. function=hydrogen-transporting ATP synthase activity, rotational mechanism; Cellular component=proton -transporting ATP synthase complex (sensu Eukarya); Biological process=ATP synthesis coupled proton transport
  Coding regions on vcDNA: vcDNA=SeqID_95658; Strand=+; Position=31-637
MFRVAKTPAHYQQSVRSFATLKDISIRLKSIKNIQKITKSMKMVSAAKYAKAERELKGARTYGEGAQFFVSNITAGDQTEPVKVAESVVESAGRKRLLILMSSDRGLCGSVHTSVAKTAKNIMANKPADVDYKIVCIGDKAKMLMQRLYAQXFLFTVNDIGRSPPTFQDASIAANAILSSGYEFDGGEILFNRFKTVVSFET

SEQ ID NO: 169236 - protein, 61 aa, Heterodera glycines; identical to SEQ ID NO: 166337
  Coding regions on vcDNA: vcDNA=SeqID_95659; Strand=-; Position=4-189

SEQ ID NO: 169237 - protein, 140 aa, Heterodera glycines; identical to SEQ ID NO: 164430
  Coding regions on vcDNA: vcDNA=SeqID_95660; Strand=+; Position=27-449

SEQ ID NO: 169238 - protein, 195 aa, Heterodera glycines
  Homolog annotation: Hit_ID=EAA01568.2; Match level="QueryCoverage =86%, HitCoverage=26%, E-value=2e-17, Identity=31%"; Hit description =ENSANGP00000019874 [Anopheles gambiae str. PEST]
  Gene Ontology: Biological process=regulation of protein activity, epigenetic
  Coding regions on vcDNA: vcDNA=SeqID_95661; Strand=+; Position=13-600
MLPSMSKKQRKPEQNNRQLRIIEVQLFTPTARRYPHFDYEEMCKELGLEISKQKETAESNSFHDQDAEEIVRRLEAKYGSQTVVSLPSTWKKPRKKTKKAIKFAPEDVMDKGLGYDLEDDFIDDEQAYDEWVPTTMDTAKRGHYVNKGPLEFRQIDFDQTTSEEDEEKDGEEESNGTRRETSILEADEEEAMNME

SEQ ID NO: 169239 - protein, 220 aa, Heterodera glycines
  Coding regions on vcDNA: vcDNA=SeqID_95662; Strand=+; Position=1-660
GAFSASHFSYSTSVTAASSANSKTPTNCSTISDPKTQRPQSSPAGTMAEGWQNRLENLEFIDDDIISGEECPLIRPNSSGKVPTANVPSNFLSNTTMPHKLQTTSTRKDSNCSVTSLLPNAEKESDKSFAGVALSCGGGKKAHQLNDIKAVVEKLSRLAFELSATRHHSSTIHSTLSHVRLKPSAKFELLDIDLEKFQTLQNSRSSASPSSAGTPSDQLP

SEQ ID NO: 169240 - protein, 420 aa, Heterodera glycines
  Homolog annotation: Hit_ID=NP_501359.1; Match level="QueryCoverage =98%, HitCoverage=97%, E-value=1e-106, Identity=47%"; Hit description= molybdenum cofactor synthesis 3 (44.5 kD) (4I895) [Caenorhabditis elegans] gb|AAB92067.2| Hypothetical p
  Gene Ontology: Mol. function=URM1 activating enzyme activity; Biological process=protein modification
  Coding regions on vcDNA: vcDNA=SeqID_95663; Strand=+; Position=55-1317
MSATTHSLSKQEIARFSRQLMLKGIGPSGQERIRETKVLIIGAGGLGCPVSMYLVAAGIGRLGIVDHDVVSIDNLHRQTMHDQKRVGQSKADSLKESLSRINNEANVVAYNVLLTSKNVLQLFRDYDIVADCSDNVATRYLINDACVLSGKPLVYGSALGWEGQFTVYNNGTNCPCFRCIFPDPPSPEHVMSCSEAGVLGPVVGVIGSLQALEIIKIAVSGKSSFAGNLWMFDGFEGISKRISLREKMSNCAICSENPRITELQDYQKFCRSDPSNKVRSLCLLSAEQPVSPTEYLNLRNKIGGSFILLDVRPPTEFEICHLPEAENFPWEELRRAKMEMIIDKINNSMERKSPTINGAGNNGKTKVLVVCHHGNDSQLAACHLHKQLSEAGIGDRFIVRDIVGGMDGWALEVDADFPRY

SEQ ID NO: 169241 - protein, 162 aa, Heterodera glycines
  Homolog annotation: Hit_ID=NP_491791.1; Match level="QueryCoverage =97%, HitCoverage=98%, E-value=7e-43, Identity=53%"; Hit description =putative mitochondrial protein, with a coiled coil-4 domain, of bilaterial origin (19.1 kD) (1G786) [Caen
  Coding regions on vcDNA: vcDNA=SeqID_95664; Strand=+; Position=4-492
MLMTSRILRLWQPGAPRPRVFLPDFWIKLVEQPSKGYNRLPKNAAAFEVDLKMSRMDVREYLEKIYKYPVRDVRIRVTMGDITWDHPKDRDKRRALWKEEDRKIAIVFFKKGFIAEVPDLFPGRGTDAEIDQMKKFQEQDANTFNSRFVNRGRAGIGEMLPI

SEQ ID NO: 169242 - protein, 139 aa, Heterodera glycines
  misc_feature (82)..(82): Xaa can be any naturally occurring amino acid
  Homolog annotation: Hit_ID=AAK93710.1; Match level="QueryCoverage =94%, HitCoverage=13%, E-value=6e-21, Identity=40%"; Hit description =putative argonaute AGO1 protein [Arabidopsis thaliana] gb|AAK59586.1| putative Argonaute (AGO1) protein [A
  Gene Ontology: Mol. function=translation initiation factor activity; Cellular component=eukaryotic 48S initiation complex; Biological process=establishment and/or maintenance of chromatin architecture
  Coding regions on vcDNA: vcDNA=SeqID_95665; Strand=+; Position=3-420
PEYIFIFRDGLSEGQFAMACKEELRALKQGCVEYDSRYQPKFVMIVGTKRHFKKFFLEEEGRKGRPFNQNLTPGSIIQDKVXRADITEFFLQPHAPIHGTGKPVEYTMLEDEIGISMDELQGVIMALSYSHQIVNVEVS

SEQ ID NO: 169243 - protein, 82 aa, Heterodera glycines; identical to SEQ ID NO: 166328
  Coding regions on vcDNA: vcDNA=SeqID_95666; Strand=+; Position=2-250

SEQ ID NO: 169244 - protein, 59 aa, Heterodera glycines; identical to SEQ ID NO: 163346
  Coding regions on vcDNA: vcDNA=SeqID_95667; Strand=+; Position=3-182

SEQ ID NO: 169245 - protein, 132 aa, Heterodera glycines
  misc_feature (40)..(40): Xaa can be any naturally occurring amino acid
  misc_feature (45)..(45): Xaa can be any naturally occurring amino acid
  misc_feature (93)..(93): Xaa can be any naturally occurring amino acid
  Homolog annotation: Hit_ID=CAE60152.1; Match level="QueryCoverage =100%, HitCoverage=79%, E-value=1e-26, Identity=47%"; Hit description= Hypothetical protein CBG03702 [Caenorhabditis briggsae]
  Gene Ontology: Cellular component=cytosolic ribosome (sensu Eukarya); Biological process=ribosomal large subunit biogenesis
  Coding regions on vcDNA: vcDNA=SeqID_95668; Strand=+; Position=2-397
RLEKCWFCSSTIYPGHGIQFVRNDATVFKFCRSKCNKLFXKRRRXPRKLKWNKGIAGEFGEKELVNDVYSGHGKFAKNQPPKFVGTLWENGVXAIREISAFFHRRCRKTIKNPLEPGKQTVEKGMVEKTPQK

SEQ ID NO: 169246 - protein, 106 aa, Heterodera glycines; identical to SEQ ID NO: 166324
  Homolog annotation: Hit_ID=NP_498638.1; Match level="QueryCoverage =97%, HitCoverage=17%, E-value=2e-36, Identity=66%"; Hit description =ALDH9B2, ALdehyde deHydrogenase (alh-12) [Caenorhabditis elegans]
  Gene Ontology: Mol. function=oxidoreductase activity, acting on the aldehyde or oxo group of donors, NAD or NADP as acceptor; Cellular component=cytosol; Biological process=carnitine metabolism
  Coding regions on vcDNA: vcDNA=SeqID_95669; Strand=+; Position=3-323

SEQ ID NO: 169247 - protein, 162 aa, Heterodera glycines
  Homolog annotation: Hit_ID=NP_493349.1; Match level="QueryCoverage =100%, HitCoverage=41%, E-value=9e-59, Identity=69%"; Hit description= GTP-binding protein like (44.4 kD) (1N935) [Caenorhabditis elegans] emb|CAB07131.1| Hypothetical protein
  Gene Ontology: Cellular component=cytoplasm
  Coding regions on vcDNA: vcDNA=SeqID_95670; Strand=+; Position=1-486
ELRLKDQAYLVGALDKVEKLAVRANDKTKKLEHDTLLKVKELLETKFVRQHEWNEKEIEVLNKHLFLTAKPIVYLVNLSEQDFIKKKNKWLPKIKAWIDENDPGAVLIPFSGAFELKSVELDPEARAQFFKDTGACSALDKIIKTGYKTLCLEYFFTAGKDE

SEQ ID NO: 169248 - protein, 68 aa, Heterodera glycines; identical to SEQ ID NO: 163313
  Homolog annotation: Hit_ID=NP_496970.1; Match level="QueryCoverage =80%, HitCoverage=55%, E-value=1e-09, Identity=52%"; Hit description =high Mobility Group protein (10.6 kD) (hmg-1.1) [Caenorhabditis elegans] emb|CAB54448.2| Hypothetical pro
  Coding regions on vcDNA: vcDNA=SeqID_95671; Strand=+; Position=50-256

SEQ ID NO: 169249 - protein, 75 aa, Heterodera glycines; identical to SEQ ID NO: 163775
  Coding regions on vcDNA: vcDNA=SeqID_95672; Strand=+; Position=34-261

SEQ ID NO: 169250 - protein, 125 aa, Heterodera glycines; identical to SEQ ID NO: 163343
  Coding regions on vcDNA: vcDNA=SeqID_95673; Strand=+; Position=24-401

SEQ ID NO: 169251 - protein, 274 aa, Heterodera glycines
  Homolog annotation: Hit_ID=CAE66560.1; Match level="QueryCoverage =27%, HitCoverage=25%, E-value=1e-11, Identity=42%"; Hit description =Hypothetical protein CBG11872 [Caenorhabditis briggsae]
  Coding regions on vcDNA: vcDNA=SeqID_95674; Strand=+; Position=19-840
LIMPCQLPNEIATVTDDVFSYMCNLAMEKCSKKADKKKASCGGAAMRKRLLIKNFVAQMLAQDRHSRELSSPTSDCSSHLNQTFDESFDFPSCQSGANAVDQFGDDMEMDAIGEEVPSNATNDAFLCLDQPSSLLTDLDDVSCDPQQQCHSSCNRKRPWSLVFSADATATADSMPMPSLCSMGVVVDQYNHHHLSNTNNSVVDMFTAATSAQHHHFINSTANNINNNGVLHSSAPPLLSPLCCGMLQMSPFGSATAAGEAMLFNGAGGGAGGVG

SEQ ID NO: 169252 - protein, 108 aa, Heterodera glycines; identical to SEQ ID NO: 166318
  Coding regions on vcDNA: vcDNA=SeqID_95675; Strand=+; Position=282-608

SEQ ID NO: 169253 - protein, 185 aa, Heterodera glycines
  Homolog annotation: Hit_ID=NP_492339.1; Match level="QueryCoverage =100%, HitCoverage=96%, E-value=8e-66, Identity=63%"; Hit description= CalPoNin (21.1 kD) (cpn-1) [Caenorhabditis elegans] emb|CAB02104.1| Hypothetical protein F43G9.9 [Caenor
  Gene Ontology: Mol. function=troponin C binding; Cellular component =cytoskeleton; Biological process=muscle contraction
  Coding regions on vcDNA: vcDNA=SeqID_95676; Strand=+; Position=2-559
ERATKTGLAAEAQQKIHSKFDLELSKQIFGWISQVTGESFTVSGEVEEYLTTLKDGTGLCQLENDLSPNSIKKINTSNFPFKQMENISFFLGFAEKYVNKSELFQTVDLFEGQDPNSVLICLAALARKSEKSFGKAGLGPKEAEGSKKEWTSEQLRAGDAIIGLQMGSNKGANQSGMIMGNTRHM

SEQ ID NO: 169254 - protein, 151 aa, Heterodera glycines
  Homolog annotation: Hit_ID=AAH71128.1; Match level="QueryCoverage =98%, HitCoverage=52%, E-value=9e-28, Identity=46%"; Hit description =MGC81473 protein [Xenopus laevis]
  Gene Ontology: Mol. function=carbonyl reductase (NADPH) activity; Cellular component=cytosol
  Coding regions on vcDNA: vcDNA=SeqID_95677; Strand=+; Position=28-480
MAGKIFVVTGANKGIGYGIARGLAQQVNGATIYMTARTPSLGEKALDDLEKELGIKRISKLAFHQLDITDEKSCADFAAFLKKTHGGLDVLINNAGFAYKHNATESAAIQADVTIGVNYYGTKLISDQLGPLIRDGGRIVNVCSQMGVMGS

SEQ ID NO: 169255 - protein, 177 aa, Heterodera glycines
  Coding regions on vcDNA: vcDNA=SeqID_95678; Strand=+; Position=78-608
MVVLPIFAAVAGAVGEDKKRQRTGEAEEQLDGDGVITSAEQPTTTANSECSSIVGEATDGGGKTPTGGETVTNEYQQQCHRNNIINSGGSCPLALSSSERMVSELIAAVIEQSRQRQQLQKHQQQLLISTNKVEETNNSGGSENEAEGEERGDEMAPEEAQAAGTFCPRCSTRSKAV

SEQ ID NO: 169256 - protein, 26 aa, Heterodera glycines
  Coding regions on vcDNA: vcDNA=SeqID_95679; Strand=-; Position=3-80
EVEVNLVITDYCMPGMTGYDLLKKIK

SEQ ID NO: 169257 - protein, 228 aa, Heterodera glycines
  Homolog annotation: Hit_ID=EAA10559.3; Match level="QueryCoverage =91%, HitCoverage=52%, E-value=8e-18, Identity=37%"; Hit description =ENSANGP00000021579 [Anopheles gambiae str. PEST]
  Gene Ontology: Mol. function=structural molecule activity; Cellular component=intercellular junction; Biological process=cell adhesion
  Coding regions on vcDNA: vcDNA=SeqID_95680; Strand=+; Position=69-752
MVVPPAPQIPKKIAEEHKKNGTQPQKEESKKDIGKKKQPQMAERRESSGESGKRGRGSGMSRESSKRAQGNSRKRGRERSRESSGDKGRKTMRRSSRSRSVKRRRRDSSSSSYSSTSRSRSRSRSYRRSPKRSPARDRRRDRTRRSTSNSSRSSSSSSASSSSQYSSSERSHSQSRSFTSDRDEEEERIRDRIIARTLSTSVTAAPAKQPQSKDDGVAMDEAMEYGPK

SEQ ID NO: 169258 - protein, 136 aa, Heterodera glycines; identical to SEQ ID NO: 166312
  Coding regions on vcDNA: vcDNA=SeqID_95681; Strand=+; Position=80-490

SEQ ID NO: 169259 - protein, 64 aa, Heterodera glycines
  Homolog annotation: Hit_ID=AAF76925.1; Match level="QueryCoverage =98%, HitCoverage=42%, E-value=2e-18, Identity=61%"; Hit description =hypothetical esophageal gland cell secretory protein 11 [Heterodera glycines]
  Coding regions on vcDNA: vcDNA=SeqID_95682; Strand=+; Position=445-636
MKVKLYDHDKGPDADDLMGTTTTDEQGRFQVSGKTTELTTIDVQLRIYHDCDDGMMPCQRKVTF

SEQ ID NO: 169260 - protein, 407 aa, Heterodera glycines
  Homolog annotation: Hit_ID=CAE68086.1; Match level="QueryCoverage =93%, HitCoverage=72%, E-value=7e-60, Identity=37%"; Hit description =Hypothetical protein CBG13719 [Caenorhabditis briggsae]
  Gene Ontology: Mol. function=transcription factor activity; Cellular component=transcription factor TFIIH complex; Biological process=DNA repair
  Coding regions on vcDNA: vcDNA=SeqID_95683; Strand=+; Position=1-1221
VQNEFGRRPLLGYLASLSDELVQQLFESRPCVVAIFRLLPAFAQQSVLQLMFHKSSDWRSWTRSRFHLAMSSAVQLLFRLRILEGNSNGDFQINLDFRMNYVSSLLANPLELSNLKMHHLDEEKARKATKDLMGKSVERWESILCYLALPSEAAEKSVSETTKDLFQFIGLVRGRAKEPEISSIGFQFLLLGRSEQIWAYLIHYMRFIASKGEEVFPVLDFLLRLTLCINGDDALAQPLRLDPNWPEIVQAFVVTLRELGLIFIRKRKDGWFLLTPLMTQLSVAASAEPLEENAGQNGVALRNSPLTNSHATNGTKGGRNGDGFLIVETNYRVYAYTNSTLQLAILSTFTELLYRFQDIAIGVLSRDAVRRAFQTGITARQITQYLSTNIRQPPSARNNSQLSDSSV

SEQ ID NO: 169261 - protein, 91 aa, Heterodera glycines; identical to SEQ ID NO: 162611
  Coding regions on vcDNA: vcDNA=SeqID_95684; Strand=+; Position=224-499

SEQ ID NO: 169262 - protein, 88 aa, Heterodera glycines
  Coding regions on vcDNA: vcDNA=SeqID_95685; Strand=-; Position=2-265
PFCLGRCGGRWACECAWGKRCWGPWPTAAARPLSIFPPPPPPPRFVLFALCGKIVAFFGSTVPFCLIVRATSTYYCCCFFRIKIKFVP

SEQ ID NO: 169263 - protein, 103 aa, Heterodera glycines
  Coding regions on vcDNA: vcDNA=SeqID_95686; Strand=-; Position=3-311
SIHSINFQYLSPILHANLSKLDIFSKNSCAFSAVFSIAYDEFVPFVSSPSIGNEMISLKLFLHSSSGHFSTKVIRQKAIERAKRSEREGGILRKYLADISAKF

SEQ ID NO: 169264 - protein, 79 aa, Heterodera glycines; identical to SEQ ID NO: 163331
  Homolog annotation: Hit_ID=NP_502317.1; Match level="QueryCoverage =100%, HitCoverage=14%, E-value=5e-28, Identity=68%"; Hit description= proline HYdroxylase (61.5 kD) (phy-2) [Caenorhabditis elegans] emb|CAA93469.1| Hypothetical protein F35G
  Gene Ontology: Mol. function=protein binding; Cellular component =extracellular space; Biological process=embryonic development
  Coding regions on vcDNA: vcDNA=SeqID_95687; Strand=+; Position=1-240

SEQ ID NO: 169265 - protein, 49 aa, Heterodera glycines; identical to SEQ ID NO: 162384
  Homolog annotation: Hit_ID=S47538; Match level="QueryCoverage=97%, HitCoverage=13%, E-value=1e-17, Identity=66%"; Hit description =acrosin (EC 3.4.21.10) precursor - rabbit gb|AAA61630.1| preproacrosin prf||2019255A prepro-acrosin sp|P48038|
  Gene Ontology: Mol. function=calcium-dependent phospholipid binding; Cellular component=synaptic junction; Biological process=synaptic vesicle targeting
  Coding regions on vcDNA: vcDNA=SeqID_95688; Strand=+; Position=3-152

SEQ ID NO: 169266 - protein, 210 aa, Heterodera glycines
  Homolog annotation: Hit_ID=AAS52858.1; Match level="QueryCoverage =99%, HitCoverage=33%, E-value=7e-15, Identity=30%"; Hit description =AER177Wp [Ashbya gossypii ATCC 10895] ref|NP_985034.1| AER177Wp [Eremothecium gossypii]
  Gene Ontology: Biological process=axon guidance
  Coding regions on vcDNA: vcDNA=SeqID_95689; Strand=+; Position=1-630
HLRNTPQSPAATAPPTSSQSQHFQQRPHVAYHQPPQQHYPLQQETNQSQHIRPQPGVRPAHPQQHPTEQQYPSMAGPLFQSQPSSVQALQEHEIGNVGQPRLAQHGHTHISHQQQVMMGQRHATHHPSQQQTLISQQQSQHPQQQHPTTAIRIEQSGQVVHMHAAPPAPPQHQTQRIFVQQQQQQQMVPTLPPQSAHDPSLHPPPLPHPH

SEQ ID NO: 169267 - protein, 212 aa, Heterodera glycines; identical to SEQ ID NO: 162360
  Homolog annotation: Hit_ID=AAG21336.2; Match level="QueryCoverage =100%, HitCoverage=86%, E-value=1e-119, Identity=100%"; Hit description=hypothetical esophageal gland cell secretory protein 6 [Heterodera glycines] sp|Q9BN19|HSP6_HETGL Putat
  Coding regions on vcDNA: vcDNA=SeqID_95690; Strand=+; Position=4-639

SEQ ID NO: 169268 - protein, 123 aa, Heterodera glycines
  Coding regions on vcDNA: vcDNA=SeqID_95691; Strand=+; Position=2-373
MTEATKIYNRLSAFQKFRINLNCHLRRVRSNWLYQLSTALVFVTALNHASIYLTYGPDHPRCMQQWKERKQRGLLTDELLWKERLLYARRREFLTAVDGYGTVDNWKHPRATMGASTLSSKLF

SEQ ID NO: 169269 - protein, 92 aa, Heterodera glycines; identical to SEQ ID NO: 162578
  Homolog annotation: Hit_ID=CAE59600.1; Match level="QueryCoverage =85%, HitCoverage=42%, E-value=8e-13, Identity=48%"; Hit description =Hypothetical protein CBG03007 [Caenorhabditis briggsae]
  Coding regions on vcDNA: vcDNA=SeqID_95692; Strand=+; Position=364-639

SEQ ID NO: 169270 - protein, 152 aa, Heterodera glycines
  Homolog annotation: Hit_ID=AAC19750.1; Match level="QueryCoverage =92%, HitCoverage=25%, E-value=2e-45, Identity=65%"; Hit description =putative glutamate dehydrogenase [Haemonchus contortus]
  Gene Ontology: Cellular component=mitochondrion; Biological process =glutamate catabolism
  Coding regions on vcDNA: vcDNA=SeqID_95693; Strand=+; Position=116-571
MLIACIPKRIHLNLNVVGAALRQRMPFSAAVLDPHDQLKDSDKPMSEQMNPSFFKMVDYYFDKGAAVIEPKLVENFKASHGKSKEERVSSVKGILAAIKPVNKVLYVTFPLRRDDGSYEMIEAWRAMHSEHRTPTKGGIRFSMDVNEDEVKA

SEQ ID NO: 169271 - protein, 53 aa, Heterodera glycines
  Coding regions on vcDNA: vcDNA=SeqID_95694; Strand=-; Position=6-167
VSVVPSPPFADSMFQSGTFTRGTDLAFFAATTGEAHKKAIISIRRRKKRILIG

SEQ ID NO: 169272 - protein, 51 aa, Heterodera glycines; identical to SEQ ID NO: 162218
  Coding regions on vcDNA: vcDNA=SeqID_95695; Strand=-; Position=392-547

SEQ ID NO: 169273 - protein, 363 aa, Heterodera glycines
  misc_feature (44)..(44): Xaa can be any naturally occurring amino acid
  misc_feature (104)..(104): Xaa can be any naturally occurring amino acid
  misc_feature (162)..(162): Xaa can be any naturally occurring amino acid
  misc_feature (184)..(184): Xaa can be any naturally occurring amino acid
  Homolog annotation: Hit_ID=NP_502269.1; Match level="QueryCoverage =96%, HitCoverage=94%, E-value=1e-115, Identity=60%"; Hit description= zinc-containing alcohol dehydrogenase superfamily (40.2 kD) (4M724) [Caenorhabditis elegans] emb|CAA9808
  Coding regions on vcDNA: vcDNA=SeqID_95696; Strand=+; Position=2-1093
AATTAWISIGSPNDLNEEHFPDEYEPPDVPNYGAKVKVCYARVXLADKEISRARRLRLTPSAQDTRLFPDYEVPGVIHDLGPEAPPGEYDSQVAHLVIEWASDXMCQHGYADYGAVPHLPLLAEIPDTLAMHVATSLPASASWALSASVHAQPVVEDITSTXGCCSIFTAAAGGLGLWILTLAXAFLTAGLDNTIKLIVAASIDERLCLTEHHVPDFLVHCDDSESFEYIFLRTLARLTNGLHIVFDFVTSPRTGARSLKCLSEGGVLFIGGISGLDVQLPIQLVAKNRLAIMGVTRGSIEQLKNLVTLLSEGQLNAPNYRVYPVDQASQVLKQLSMSEVEGRAILEVFNPDTEVKKAEEEQK

SEQ ID NO: 169274 - protein, 35 aa, Heterodera glycines; identical to SEQ ID NO: 166298
  Coding regions on vcDNA: vcDNA=SeqID_95697; Strand=+; Position=34-141

SEQ ID NO: 169275 - protein, 140 aa, Heterodera glycines; identical to SEQ ID NO: 166297
  Coding regions on vcDNA: vcDNA=SeqID_95698; Strand=+; Position=9-431

SEQ ID NO: 169276 - protein, 168 aa, Heterodera glycines
  Coding regions on vcDNA: vcDNA=SeqID_95699; Strand=+; Position=3-506
SCRIRHEGPIKGLFIFPAYLMARKNLCRKTFATFKQEERYPIVQRAIGARWGRKTIQTPNIEEEALQSVELRPSTSAEDFVESPPLTPSIATTSEVDVLSAETVEFGGSFSATAAQMDIFESTPSTFVVQMDIEETTPSPFTVNDRSQRIEQLENQLNDRDDKNLWED

SEQ ID NO: 169277 - protein, 142 aa, Heterodera glycines
  Homolog annotation: Hit_ID=CAE71248.1; Match level="QueryCoverage =96%, HitCoverage=64%, E-value=4e-50, Identity=68%"; Hit description =Hypothetical protein CBG18124 [Caenorhabditis briggsae]
  Gene Ontology: Mol. function=SH3/SH2 adaptor protein activity
  Coding regions on vcDNA: vcDNA=SeqID_95700; Strand=+; Position=49-474
MASAKCAREDCGKTVYPLEELKCLDKVWHKTCFKCTDCGMILSMKSYKGYDKKPYCQAHYPKTVPSAVAATPEMEQAKRNTAYQSQVKYHEAYEKQMKGTKMEVADDPETMRHKANMVNQSLAHYHGELQKKEKQDSQRDTT

SEQ ID NO: 169278 - protein, 116 aa, Heterodera glycines
  Coding regions on vcDNA: vcDNA=SeqID_95701; Strand=-; Position=5-355
FELKMNVYFFGIHPEFFFFFFFFTHSIHSLFTTAQNALIPSAATGTDVERCFGFLPAFVHFLVVPTGHLFIPISRNKIGANEKADNYQQKKHNETQMEHLEKAENYLKLLKAENYL

SEQ ID NO: 169279 - protein, 62 aa, Heterodera glycines
  Coding regions on vcDNA: vcDNA=SeqID_95702; Strand=-; Position=3-188
SQRNLLQPKIIYDKKKCRDRKEETIKGIRKSIFMEKQKRLSTTKIANGPKITPNRAKNAQYE

SEQ ID NO: 169280 - protein, 100 aa, Heterodera glycines; identical to SEQ ID NO: 163324
  Coding regions on vcDNA: vcDNA=SeqID_95703; Strand=+; Position=73-375

SEQ ID NO: 169281 - protein, 183 aa, Heterodera glycines
  Homolog annotation: Hit_ID=CAA74206.1; Match level="QueryCoverage =87%, HitCoverage=46%, E-value=6e-87, Identity=99%"; Hit description =serine proteinase [Heterodera glycines]
  Coding regions on vcDNA: vcDNA=SeqID_95704; Strand=+; Position=1-549
GAPRGGGRSSIVDPPGCRIPARGLDIILVTIGYKSFSLSEHISEFSECGISDFEPEFPIAPKVEIGTNHIFKGKTIVDDKSLPWMARILSGVSCTATIIGPRHVLTAAHCVEGQALENFVVSYGSADASNQQHKSGVEAIKYHPKTQHYEIKDKFRKNTRAYLFLNDIVVIKIKNSIKFSQNA

SEQ ID NO: 169282 - protein, 149 aa, Heterodera glycines
  Homolog annotation: Hit_ID=AAK94489.1; Match level="QueryCoverage =100%, HitCoverage=70%, E-value=4e-79, Identity=98%"; Hit description= putative S-adenosylmethionine synthetase [Heterodera glycines]
  Gene Ontology: Mol. function=methionine adenosyltransferase activity; Cellular component=cytoplasm; Biological process=amino acid metabolism
  Coding regions on vcDNA: vcDNA=SeqID_95705; Strand=+; Position=101-547
MDAVKAPTLASIHHKNRLQSPLNAHGHPLIIENGTVAETLVDKEEEELTEQVGTFLFTSESVGEGHPDKMCDQISDAILDAHLALDPAAKVACEVVTKTGMVLVCGEITSSATVDYQSVVRETIKKIGYDDSSKGFDYKTCNVLVALEK

SEQ ID NO: 169283 - protein, 109 aa, Heterodera glycines
  Coding regions on vcDNA: vcDNA=SeqID_95706; Strand=+; Position=33-359
MDEGTTENNNNRKSGAKKRKQKQKQQSVVAEVTEPHNKQSETEEAEKEKSKNGDSEKDGKKVNEASKPIPCQSISVIGDTVKSTILFITFILYSKILFYFSLIIKFCLA

SEQ ID NO: 169284 - protein, 190 aa, Heterodera glycines; identical to SEQ ID NO: 165760
  Homolog annotation: Hit_ID=CAF96120.1; Match level="QueryCoverage =54%, HitCoverage=29%, E-value=4e-15, Identity=43%"; Hit description =unnamed protein product [Tetraodon nigroviridis]
  Coding regions on vcDNA: vcDNA=SeqID_95707; Strand=+; Position=1-573

SEQ ID NO: 169285 - protein, 209 aa, Heterodera glycines
  Homolog annotation: Hit_ID=NP_496492.1; Match level="QueryCoverage =99%, HitCoverage=25%, E-value=6e-38, Identity=46%"; Hit description =Dyggve-Melchior-Clausen syndrome protein like, possibly N -myristoylated (78.2 kD) (2L967) [Caenorhabditis
  Coding regions on vcDNA: vcDNA=SeqID_95708; Strand=+; Position=3-629
FPPQSLSTLSLALLLSLVYYPSFEGRTNAYKQMLSIFQNAQEVSSLANLEASFKLDFTHLYNRLCATLHSERMPLLLLYLLLHNNVGFRNFVLSRINLEQLVLPVVRVLYDGMCSVPGHGFQRSSPTSSPKMRRQSQFSHNNSTVHTHQTYLALIVLLMLSEDDFFKKVIHEMTIKNIDWYTLDRTTHLAETTLGGLIVLVFSKTIQIN

SEQ ID NO: 169286 - protein, 211 aa, Heterodera glycines
  Coding regions on vcDNA: vcDNA=SeqID_95709; Strand=+; Position=1-633
DTMNFVKRIDFYYDVTTISSWIMFERLNVTRRLCPSIEYNFRPVHYSSLLTSAGSLVPFSTAALRKNFFEQQRELARVHGITIGTRHGVIDDLLAKLSNTVLPQCFMNMVASESGHESLIELSRSFWRKLWISNVHLDHEEFLESLRQLNIQIPPDEIIFDNRWGKLIEQWHCELLNQHQCFDVPWTVLHFDNDTTKNFNSFDKWPLIASL

SEQ ID NO: 169287 - protein, 219 aa, Heterodera glycines
  Coding regions on vcDNA: vcDNA=SeqID_95710; Strand=+; Position=3-659
VGCASFGAGNKYRDCDFPRLIYPSVGSVFTDSYCWYVNVTCEEANYGLPAYIEFNENPSTIVAAPEPTLGRRITVTLQCVGNSYGQRVWTKFGVDGDPSAVVQVKTVRCGTKCATNVSTTPATLTSPNSEGLPYCRDSCAARIGHGTRGQDCDQTLLNNALIVYPSYPYILYGCWYVSVTCEAKANGNPIYIKLNDEEKTIVTSTQPPFNKITVNLQCA

SEQ ID NO: 169288 - protein, 201 aa, Heterodera glycines; identical to SEQ ID NO: 162337
  Homolog annotation: Hit_ID=XP_395154.1; Match level="QueryCoverage =73%, HitCoverage=86%, E-value=9e-17, Identity=35%"; Hit description =similar to ENSANGP00000020219 [Apis mellifera]
  Gene Ontology: Mol. function=transcription co-repressor activity
  Coding regions on vcDNA: vcDNA=SeqID_95711; Strand=+; Position=32-634

SEQ ID NO: 169289 - protein, 123 aa, Heterodera glycines; identical to SEQ ID NO: 163169
  Homolog annotation: Hit_ID=XP_478998.1; Match level="QueryCoverage =92%, HitCoverage=15%, E-value=4e-12, Identity=40%"; Hit description =putative diaphanous homologue [Oryza sativa (japonica cultivar -group)] dbj|BAC55695.1| putative diaphanou
  Gene Ontology: Mol. function=SH3-domain binding; Cellular component =lamellipodium; Biological process=actin filament organization
  Coding regions on vcDNA: vcDNA=SeqID_95712; Strand=-; Position=11-481

SEQ ID NO: 169290 - protein, 128 aa, Heterodera glycines
  Homolog annotation: Hit_ID=EAL01937.1; Match level="QueryCoverage =97%, HitCoverage=100%, E-value=4e-22, Identity=39%"; Hit description= hypothetical protein CaO19.11807 [Candida albicans SC5314]
  Coding regions on vcDNA: vcDNA=SeqID_95713; Strand=-; Position=92-478
FFLLLLLFLLLFFLLLLLLLLLFFLLLLLLLLLFFLLLLLLLLLFFLLLLLFLLLFFLLLLLLLLLFFFLLLLLFLFLLFFFLLLLFFFPLLLLLLLLFFLVLLYLFFVFLFYFSAYILAVFLIGSVL

SEQ ID NO: 169291 - protein, 119 aa, Heterodera glycines
  Coding regions on vcDNA: vcDNA=SeqID_95714; Strand=-; Position=179-538
FRPNKVKPTIFTQFVEKPGKDLWFYCDNHNSTWLFHFAVKFIICICILVTLCLKLKTVPSQSQSLKTVQRKAVSLDLEQIFTSDLSIKPAETNPCTKAVAILPPPMTVKHFSRSLKHST

SEQ ID NO: 169292 - protein, 158 aa, Heterodera glycines
  Homolog annotation: Hit_ID=CAE61904.1; Match level="QueryCoverage =79%, HitCoverage=16%, E-value=5e-46, Identity=72%"; Hit description =Hypothetical protein CBG05896 [Caenorhabditis briggsae]
  Gene Ontology: Mol. function=phospholipase C activity; Cellular component=intracellular; Biological process=phosphatidylinositol-45 -bisphosphate hydrolysis
  Coding regions on vcDNA: vcDNA=SeqID_95715; Strand=+; Position=3-476
TGLQVHGNATVEGYISALRRGSRLLELDVFDGEHGEPQITHKRTFIGAISLRNVLKCVKNYAFVQNPYPVILTIENHVGFVQQRIMADIFQEILGDHLLIPSDDLHTKPLPSPQQLKHKVLLRGKTAGGATTADINGGGTHAETTAATMAPASVAANN

SEQ ID NO: 169293 - protein, 203 aa, Heterodera glycines
  Homolog annotation: Hit_ID=NP_491109.1; Match level="QueryCoverage =91%, HitCoverage=34%, E-value=5e-12, Identity=31%"; Hit description =putative prenylated protein of eukaryotic origin (1D717) [Caenorhabditis elegans] pir||T32924 hypothetica
  Coding regions on vcDNA: vcDNA=SeqID_95716; Strand=+; Position=8-616
MDSPKCQTLNFARPFFPNNFVLLEVEKSVADAFSSSNMITDQFNHESLSLTIRGHCSDPLVVCTSSRTFGAKDVEVSNTLLLLDGTPNGAGANQQHIVSITNRFVELSEAFLPDQTFRLKALLEQNLLDFYNENAPAAEESKGIKLNELLDHVQISEQQLREELAKFAVVEPAEGIFHLLSDECQQKFLDELVELFDDADTIG

SEQ ID NO: 169294 - protein, 97 aa, Heterodera glycines
  Coding regions on vcDNA: vcDNA=SeqID_95717; Strand=+; Position=2-292
AAAGLSSSSGSSPTILQQQQHRQFSSAISQQKSLTPPPLSVGSSTFNPTLEQLLQATQNISYSLSPLNSNGGMNGSGGEQHDGTNFNSNGTNNSNGG

SEQ ID NO: 169295 - protein, 139 aa, Heterodera glycines
  Coding regions on vcDNA: vcDNA=SeqID_95718; Strand=-; Position=26-445
SFEHLFQMDNNNQTINCSAIFRLFSYFSSNSITLYFSFSCGPSTETVVVFSWTHSFTSSNFCLIVGSTDSISHARASDSSNACFAFSYPCCIDLSPSLNLSLIPSSKSSNIPPAFERSTAQRKKRQNAKMTKGRNIWRN

SEQ ID NO: 169296 - protein, 130 aa, Heterodera glycines; identical to SEQ ID NO: 163312
  Coding regions on vcDNA: vcDNA=SeqID_95719; Strand=-; Position=14-406

SEQ ID NO: 169297 - protein, 189 aa, Heterodera glycines
  Homolog annotation: Hit_ID=EAL23807.1; Match level="QueryCoverage =97%, HitCoverage=68%, E-value=5e-18, Identity=28%"; Hit description =HUS1 checkpoint homolog (S. pombe) [Homo sapiens] gb|AAV38289.1| HUS1 checkpoint homolog (S. pombe) [Homo
  Gene Ontology: Biological process=DNA damage response, signal transduction resulting in cell cycle arrest
  Coding regions on vcDNA: vcDNA=SeqID_95720; Strand=+; Position=30-596
MRFVAVIGDGKAVDIFVKVAAVVSKLCRKRAVVRITPNEFSFVNVYNVREGMHVDFRIHKDNLFNSWSFDGLSLDNNAIFFELSTDDFVRSLHSRATQIKLKMTKKDGVPHLRVELSANSLVNEIPIVLVVLRQWPDFNPPNMGISQLAVALPNVKTLTKIVSGVKDIGGRHLIFRANNRGEFNIIGYA

SEQ ID NO: 169298 - protein, 114 aa, Heterodera glycines; identical to SEQ ID NO: 163830
  Homolog annotation: Hit_ID=NP_502668.1; Match level="QueryCoverage =90%, HitCoverage=85%, E-value=1e-17, Identity=41%"; Hit description =synaptobrevin (13.5 kD) (4O626) [Caenorhabditis elegans] emb|CAC70077.1| Hypothetical protein B0513.9 [Ca
  Gene Ontology: Cellular component=plasma membrane; Biological process= nonselective vesicle transport
  Coding regions on vcDNA: vcDNA=SeqID_95721; Strand=+; Position=37-381

SEQ ID NO: 169299 - protein, 203 aa, Heterodera glycines
  Homolog annotation: Hit_ID=NP_001002546.1; Match level="QueryCoverage= 58%, HitCoverage=46%, E-value=5e-10, Identity=36%"; Hit description =VAMP (vesicle-associated membrane protein)-associated protein A, like [Danio rerio] gb|AAH76262.1| VAM
  Coding regions on vcDNA: vcDNA=SeqID_95722; Strand=+; Position=55-663
MKRNGNSICSETKPPLLELTPKNALTFRGKLGHVGSVSLDIKNCEICSVYFKVKSNANHFYSVRPNTGVIGAYGRVKVVIQLHDDSLAKLDEIEENKHKFLIMAAIVSDASIGTEKFWKGKKEGMDGIYSSKMKTEVHKVCRWEGGKGVLSQQNSEENVPNGKNSVSVEKVPNQILELCSEKEAPNQFSNLEENVPNGKNSML

SEQ ID NO: 169300 - protein, 137 aa, Heterodera glycines; identical to SEQ ID NO: 162910
  Homolog annotation: Hit_ID=AAH78189.1; Match level="QueryCoverage =57%, HitCoverage=74%, E-value=1e-12, Identity=44%"; Hit description =Zgc:100870 protein [Danio rerio]
  Coding regions on vcDNA: vcDNA=SeqID_95723; Strand=+; Position=9-422

SEQ ID NO: 169301 - protein, 156 aa, Heterodera glycines
  Coding regions on vcDNA: vcDNA=SeqID_95724; Strand=-; Position=1-468
RKNNIYMCVYVSLLSSNFIAHLFQKFHVAIAQLAPAHASVPTGHVKLGPKADDDRDQQSEGKAEEAHSFRVLFTNSERNNCGNVGTALVTPRQHEEKAFPFGRLPAERVDGKGWSSAGPLLWWLIYLAPFRLGTVRIDGWWRLVAKKAEILCHWHC

SEQ ID NO: 169302 - protein, 110 aa, Heterodera glycines
  Coding regions on vcDNA: vcDNA=SeqID_95725; Strand=+; Position=48-380
SSSFLVFFFLRCSADVPLQFLLHRASPLHLFPKFIHFLLPEFHPIGHRSGRGEEVSEANRPPKRSADTVENEMGLGQKRNVGLVFHAKVKSGGFALSLSPFRRNFGVFST

SEQ ID NO: 169303 - protein, 141 aa, Heterodera glycines
  Homolog annotation: Hit_ID=NP_497804.2; Match level="QueryCoverage =75%, HitCoverage=20%, E-value=1e-18, Identity=45%"; Hit description =tumor endothelial marker like (56.8 kD) (3F99) [Caenorhabditis elegans] emb|CAA84646.2| Hypothetical prot
  Coding regions on vcDNA: vcDNA=SeqID_95726; Strand=+; Position=42-467
WIPRAAGFRHEASASSPTTGSSAAGTSHLGAAVAPPKAAVASDSGALPTGTPTTTETPPSTTASSTTTKATANEKRIAEEGSGGGLAFVTMFMLLGISVSVWLLYAYFNPHTRSGQLLIKYRPSKWQIPSSHVRYSASVHM

SEQ ID NO: 169304 - protein, 85 aa, Heterodera glycines; identical to SEQ ID NO: 163306
  Coding regions on vcDNA: vcDNA=SeqID_95727; Strand=+; Position=45-302

SEQ ID NO: 169305 - protein, 177 aa, Heterodera glycines
  Coding regions on vcDNA: vcDNA=SeqID_95728; Strand=+; Position=34-567
MDQLEVFLTYPPTVEDKELIATYSLAGRLLRPLLPRDENHRRLVYFTEELNSTDYFFSDGQNGRFCVVSLRLMRADKRQRMREYFNENMAVFSETYDCSFGFHELEAMEWDVAVIKVYREHMARCWNDMMGQLLYVVNMYDRGLDPVDMVRTPSAGESSNNGSDQSDVSHNDPLPSV

SEQ ID NO: 169306 - protein, 207 aa, Heterodera glycines
  Homolog annotation: Hit_ID=AAH77124.1; Match level="QueryCoverage =95%, HitCoverage=99%, E-value=1e-76, Identity=69%"; Hit description =Zgc:100812 protein [Danio rerio]
  Gene Ontology: Mol. function=RAB small monomeric GTPase activity; Cellular component=Golgi apparatus; Biological process=signal transduction
  Coding regions on vcDNA: vcDNA=SeqID_95729; Strand=+; Position=59-682
MRHAAAPIRDYDHLFKLLIIGDSGVGKSSLLLRFSDNTFSTSYITTIGVDFKIRTITVMGKKIKLQIWDTAGQERFRTITSTYYRGTHGVIVVFDVTSIESFNNVKRWLHEIDTNCENVQKILVGNKVDEPSRRAIPEAEARRFAESMRINYFETSAKENLNVEQMFQCITEIVLESCVDREKNNPRQATDVLKLRQRPEKKRKCCG

SEQ ID NO: 169307 - protein, 144 aa, Heterodera glycines
  Coding regions on vcDNA: vcDNA=SeqID_95730; Strand=+; Position=59-490
MEDQPQLSQGFFQTFLDEKVPADFQPILQVLETRTIGSSSAMGGYPPQGQQMRARLSDSLYSYSGCVIPQTVTRRFQDDGLSTHNGIIQVTSWKRVDGGKLCFFQVLDYTLYSLDFPVIGNPQPHSGNPAEFRRVVQPQKDPDT

SEQ ID NO: 169308 - protein, 116 aa, Heterodera glycines
  Homolog annotation: Hit_ID=CAE59600.1; Match level="QueryCoverage =100%, HitCoverage=52%, E-value=8e-24, Identity=50%"; Hit description= Hypothetical protein CBG03007 [Caenorhabditis briggsae]
  Coding regions on vcDNA: vcDNA=SeqID_95731; Strand=+; Position=140-487
MSNGTIFIDRDGELFAYVLDYLRTGKLLLPENFRELARLREEVQFYQIDELMQQLIPFYNLKFPPKTPTGQNNGSVALTAAVAAAVAKTNALYETGGFITLGYRGTFAFGRDGQAD

SEQ ID NO: 169309 - protein, 169 aa, Heterodera glycines
  Homolog annotation: Hit_ID=CAE62851.1; Match level="QueryCoverage =94%, HitCoverage=28%, E-value=5e-21, Identity=31%"; Hit description =Hypothetical protein CBG07030 [Caenorhabditis briggsae]
  Coding regions on vcDNA: vcDNA=SeqID_95732; Strand=+; Position=76-582
MDGDGDESYCDSDLELERSSSANNVNQLPLVPTEFTSIPEAMQNFNAVFDSRYGAQHAPFFHGSLQDAIAEAFDSPAGGAEHRRPLAIYLHDDQSVAAHIFAQTVMSNVNVSNLLKCQFILWAWDVSLADNKKHLFDWLELANLTEVSNCIGMGAAFRISDAYCADQGS

SEQ ID NO: 169310 - protein, 131 aa, Heterodera glycines
  Coding regions on vcDNA: vcDNA=SeqID_95733; Strand=+; Position=93-485
MLRIFAVRLRGQLWRLGQCALRVFALRHATAHVCSRSDDVKAFRERRIKTTIDRKSCPMPQQLIRWILVVSFLVIVLCCSALVVFYALRVIRRSFRNPVQTDGDIVFYNARNVHNFPHPAAMKQPTVEDDG

SEQ ID NO: 169311 - protein, 289 aa, Heterodera glycines
  Homolog annotation: Hit_ID=AAP05997.1; Match level="QueryCoverage =93%, HitCoverage=98%, E-value=5e-93, Identity=50%"; Hit description =galectin [Haemonchus contortus] gb|AAF63406.1| galectin [Haemonchus contortus]
  Gene Ontology: Mol. function=protein binding; Cellular component =cytoplasm; Biological process=cell adhesion
  Coding regions on vcDNA: vcDNA=SeqID_95734; Strand=+; Position=2-871
IIDESPVAIGNGGTETQLSTPFRGVLDVRFEPGQTLTVKGIVGEKARQFSVNLHSRTADFSGSDVPLRVAARVDRAKIGLNSMVNKMWGKEQRKGHSLKPGKPIDLRIRAHDKEFQIIIDGKAFKRYAYQSPLQSITHLSIDGDLAIQHIHWGGKVYPVPYETGLPHGFPIGKCLKMSGTPSLRKGGRFEVNLLRKNGHIALHLNARFDEKAVVRNSLEANEWGNEEREGKMPFERGHCFDLAITNEANHFGIFVNGQHFANFVHRSKPEDIFGLLIQGDIELTGLEME

SEQ ID NO: 169312 - protein, 94 aa, Heterodera glycines
  Coding regions on vcDNA: vcDNA=SeqID_95735; Strand=+; Position=2-286
GEETQKEGTERVGRRRRRRVAGERAQSVQRWANHRSELVQWRKWGQWDEEKRKRSERRGGKGGATANDCLEKHSRLETAQRHKPIKELINELIN

SEQ ID NO: 169313 - protein, 105 aa, Heterodera glycines
  Coding regions on vcDNA: vcDNA=SeqID_95736; Strand=-; Position=3-317
MACSVRLDHHILLPSHFFPKFPHHGPPPPIPPPYGEPYIPRLARRAAGSLSTLSSCAVISAEKAHKTTKRKAMIKRRGDIINRRCSSNLLLVKVNHLRKFSDFTI

SEQ ID NO: 169314 - protein, 109 aa, Heterodera glycines
  Homolog annotation: Hit_ID=NP_500253.1; Match level="QueryCoverage =47%, HitCoverage=9%, E-value=8e-13, Identity=63%"; Hit description =spastic paraplegia 3A homolog, atlastin, putative guanylate-binding protein, similar to ARL-6 interacting
  Coding regions on vcDNA: vcDNA=SeqID_95737; Strand=+; Position=33-359
MLAPIPIIEPATVTVPPNEDVVGSYDENQQREEELLVNQFVINSEAIKRILDDPRYADKKVCVVSVAGAFRTGKSFILNFFLRYLRWRSAPSVDEMVNDWLKMDPKLEG

SEQ ID NO: 169315 - protein, 148 aa, Heterodera glycines
  Homolog annotation: Hit_ID=NP_498111.2; Match level="QueryCoverage =98%, HitCoverage=26%, E-value=1e-37, Identity=60%"; Hit description =ATP synthase subunit (57.5 kD) (atp-2) [Caenorhabditis elegans] gb|AAA19068.2| Atp synthase subunit prote
  Gene Ontology: Mol. function=transporter activity; Cellular component= proton-transporting ATP synthase, catalytic core (sensu Eukarya); Biological process=energy pathways
  Coding regions on vcDNA: vcDNA=SeqID_95738; Strand=+; Position=33-476
MASRTFSRFASNFRLFGSVMATNLSGRSHCFVAKKSLSTSPLVYATAAAASQPTTPKATVKGKKGRVVAVIGAVVDVQFDEGLPPILNALEVQNRASRLILEVAQHLGDNVVRTIAMDGTEGLIRGQEVVDTGDPIKIPVGPETLGRI

SEQ ID NO: 169316 - protein, 107 aa, Heterodera glycines
  Homolog annotation: Hit_ID=NP_492417.1; Match level="QueryCoverage =63%, HitCoverage=2%, E-value=1e-17, Identity=60%"; Hit description =fatty acid synthase (1J552) [Caenorhabditis elegans] emb|CAB04244.1| Hypothetical protein F32H2.5 [Caenorh
  Gene Ontology: Cellular component=mitochondrion; Biological process =polar body extrusion after meiotic divisions
  Coding regions on vcDNA: vcDNA=SeqID_95739; Strand=+; Position=156-476
MCKKTKSEPCCKKLSSCFSEEMKGSQMFRQVVELRNDIATNGCIAGGVECCDLTAHTVQRRPQTTGQLFLEKLYFVKHVDNNSLADSPREREILAEYRNLLYSIILN

SEQ ID NO: 169317 - protein, 57 aa, Heterodera glycines; identical to SEQ ID NO: 163299
  Homolog annotation: Hit_ID=CAE68482.1; Match level="QueryCoverage =96%, HitCoverage=93%, E-value=2e-13, Identity=58%"; Hit description =Hypothetical protein CBG14284 [Caenorhabditis briggsae]
  Coding regions on vcDNA: vcDNA=SeqID_95740; Strand=+; Position=67-240

SEQ ID NO: 169318 - protein, 63 aa, Heterodera glycines; identical to SEQ ID NO: 166264
  Coding regions on vcDNA: vcDNA=SeqID_95741; Strand=+; Position=164-355

SEQ ID NO: 169319 - protein, 73 aa, Heterodera glycines; identical to SEQ ID NO: 163284
  Coding regions on vcDNA: vcDNA=SeqID_95742; Strand=-; Position=2-220

SEQ ID NO: 169320 - protein, 111 aa, Heterodera glycines
  Homolog annotation: Hit_ID=NP_075965.1; Match level="QueryCoverage =90%, HitCoverage=23%, E-value=2e-15, Identity=40%"; Hit description =lipocalin 7 [Mus musculus] dbj|BAB20596.1| ARG1 [Mus musculus]
  Gene Ontology: Cellular component=lysosome; Biological process =proteolysis and peptidolysis
  Coding regions on vcDNA: vcDNA=SeqID_95743; Strand=+; Position=3-338
KMMREIMTNGPIQVQVDWYVDAYLYGQNSTQVNVYMHTIVNQTDKGDYQEGSLKLIGWGEESTDKGELVKYWFGVNSFGTDWGLNGLFKWRRGTDECRIESKGISFGTPDV

SEQ ID NO: 169321 - protein, 152 aa, Heterodera glycines
  misc_feature (21)..(21): Xaa can be any naturally occurring amino acid
  Homolog annotation: Hit_ID=AAL78214.1; Match level="QueryCoverage =76%, HitCoverage=66%, E-value=1e-15, Identity=35%"; Hit description =putative esophageal gland cell protein Hgg-20 [Heterodera glycines]
  Coding regions on vcDNA: vcDNA=SeqID_95744; Strand=+; Position=12-471
MANDVWLDTLFWIDRTEAGGXHFKLRKWKLGELGIHRAPSGWDWGGTATVTVMDDHPLMNPLPLAKCPAPNGVIGFRAIYIWCVDLEVITFLQCLQRVLNLGIAVQFTIHSKDVRCWYFEAPSAISVNYVVVCHRVATPRSLSGRMNGRASG

SEQ ID NO: 169322 - protein, 173 aa, Heterodera glycines
  Homolog annotation: Hit_ID=NP_496800.1; Match level="QueryCoverage =87%, HitCoverage=43%, E-value=2e-37, Identity=50%"; Hit description =nuclear receptor-binding factor 1 like (38.2 kD) (2N476) [Caenorhabditis elegans] emb|CAB04958.1| Hypothe
  Gene Ontology: Mol. function=enoyl-[acyl-carrier protein] reductase activity; Cellular component=mitochondrion; Biological process =aerobic respiration
  Coding regions on vcDNA: vcDNA=SeqID_95745; Strand=+; Position=19-537
MVFAGVNCSTNIRWVHRWAWTSRRLCSSTKIIYEQNGNPAEVLKLSNEKIDQNAIGANEVFVRWMASPINPSDINQIQGVYPIKPPLPAVAGNEGCARVEKIGSNVRELKVGDIVLPTNAGLGTWRTHGIYQSTQLFPIDSSLQLDSIATAMLQVNPSTAYRMLHDYAKLVPG

SEQ ID NO: 169323 - protein, 158 aa, Heterodera glycines
  Coding regions on vcDNA: vcDNA=SeqID_95746; Strand=+; Position=3-476
FLNHTLSSSSTILSAAAAGANETTERFRLALDDFVTVHPHLTCALIAVSVSLATHLALFVFARLFDFALAKFRPFVRRCRLLRGGGRSFRVHISDAPLLSSNGPFIHSQFTQHQQRASGKSQLLHKVPTIEADGGDDDGGIANAEKAKRTTTPVATSR

SEQ ID NO: 169324 - protein, 157 aa, Heterodera glycines
  Coding regions on vcDNA: vcDNA=SeqID_95747; Strand=+; Position=159-632
QCVTNAKYNARNGSSPQNQIIKELPKCMLSAGAAESHITKLSKCLNKNILLPWTFVEGDTVYTQLETFTHMFAIQDCLESSADVKKVDSLVGKTCAYQLYLQYGYGASEDAAKKWLEACLHRANVGKATDALKCYSSALTDPAVIQRAADYIAKMRG

SEQ ID NO: 169325 - protein, 80 aa, Heterodera glycines; identical to SEQ ID NO: 162500
  Coding regions on vcDNA: vcDNA=SeqID_95748; Strand=-; Position=170-412

SEQ ID NO: 169326 - protein, 165 aa, Heterodera glycines
  Coding regions on vcDNA: vcDNA=SeqID_95749; Strand=+; Position=3-500
GAPRGGGRSRTSGSPGLQEFGTRERSAIDRANRAEINKVKMRLCLALFIAASALSLGRWIEAGVVEDVKDYVDAFSEISAPAATIGEQLRKISARVSKLVQLGGPVGSLAALAMQKALEPESEEMVALKLLHSTMVKRFDVLDRRVEHLGNRLVQHMALVEYDHV

SEQ ID NO: 169327 - protein, 168 aa, Heterodera glycines
  Coding regions on vcDNA: vcDNA=SeqID_95750; Strand=+; Position=28-534
MEIDEQHQANSAGHVVASGECVQQREQQQEMPDLSAMTEEEHLEYVIRLSMTGNQPTQSAQDGQHNQQHTRSPSGAMSTPAPTPMEVEEGTAGGNNAKGPAGGGVQLGDLLQHPEMLHQLVGQVPVDSSEATTKDQPTEVKESDEKKTSTKKEAERKDDNKKGNSSEN

SEQ ID NO: 169328 - protein, 67 aa, Heterodera glycines; identical to SEQ ID NO: 163289
  Homolog annotation: Hit_ID=AAL78217.1; Match level="QueryCoverage =100%, HitCoverage=23%, E-value=7e-33, Identity=98%"; Hit description= probable protein kinase C subtrate Hgg-23 [Heterodera glycines]
  Coding regions on vcDNA: vcDNA=SeqID_95751; Strand=+; Position=3-206

SEQ ID NO: 169329 - protein, 213 aa, Heterodera glycines
  Homolog annotation: Hit_ID=NP_505498.1; Match level="QueryCoverage =92%, HitCoverage=50%, E-value=5e-24, Identity=33%"; Hit description =putative mitochondrial protein (42.9 kD) (5K173) [Caenorhabditis elegans] emb|CAA94803.2| Hypothetical pr
  Coding regions on vcDNA: vcDNA=SeqID_95752; Strand=+; Position=24-662
MECIGCLAFRTSFSVLLRPFSSANFGQGARDIGSRHNVSSRHSALLEKALAPFVPRTAKELAEYLAKNVLYHSVGDVLVVHKPYGVGSLGYVQKEFGIFPTTQYKFKDRMDLFNGVKKDDSVTLEDAIPHLKEIFHEPKLHFCTGLKRWVSGPVVLPCSEKAFKNIGHSLFQGESISHSNEHWTAQHMHRALAICISRPPRDEGAVDGYATFQ

SEQ ID NO: 169330 - protein, 163 aa, Heterodera glycines
  Homolog annotation: Hit_ID=CAE66573.1; Match level="QueryCoverage =95%, HitCoverage=91%, E-value=3e-23, Identity=41%"; Hit description =Hypothetical protein CBG11890 [Caenorhabditis briggsae]
  Coding regions on vcDNA: vcDNA=SeqID_95753; Strand=+; Position=1-492
GKNKKTSSYKERKAISYQQGSDPPFLAQFKNKLGYKEWTVEDKFAKSDDEEEEEGADNPTDDIRKMREEERPQVVVLDPRTDLSAEELQKEIEKGNEEEDKRKIMEGKIMFRKPEKRKTENGCGKEGSKEEEEKEKRAKREEKPGQQQKEQNRRLLSFGEEDE

SEQ ID NO: 169331 - protein, 188 aa, Heterodera glycines
  Homolog annotation: Hit_ID=T37314; Match level="QueryCoverage=81%, HitCoverage=23%, E-value=3e-14, Identity=31%"; Hit description =probable kexin (EC 3.4.21.61) - Caenorhabditis elegans  (fragment) gb|AAA98752.1| endoprotease
  Gene Ontology: Mol. function=proprotein convertase activity; Cellular component=integral to membrane; Biological process=embryonic development
  Coding regions on vcDNA: vcDNA=SeqID_95754; Strand=+; Position=2-568
YFESAQSVCLECDKSCATCHGPGPLQCDECAQGFANHTMGYCRQCCSPDQLTQKDLHCEDCSKSYPEFRTKSHLSMLSLLANFFTIIGLVLLGTVLFYLCRQLICCCFGIGRNGNLSDLEYTPLTTIGDDLDGRKKDQKQNMGFALEDDESESDSDNAESLMEGEKSSPEAEKEQKQQRKVPTEEAES

SEQ ID NO: 169332 - protein, 216 aa, Heterodera glycines; identical to SEQ ID NO: 162622
  Homolog annotation: Hit_ID=CAE58485.1; Match level="QueryCoverage =88%, HitCoverage=47%, E-value=5e-55, Identity=56%"; Hit description =Hypothetical protein CBG01629 [Caenorhabditis briggsae]
  Gene Ontology: Cellular component=nucleolus; Biological process=cell cycle
  Coding regions on vcDNA: vcDNA=SeqID_95755; Strand=+; Position=15-662

SEQ ID NO: 169333 - protein, 158 aa, Heterodera glycines
  Coding regions on vcDNA: vcDNA=SeqID_95756; Strand=+; Position=1-474
CFFMYPPKDSDSNFFPNRMLSVDRSRSSSSHLVGLNAALQGCRSDIPFMLQRVSFSKDIKLHRMLRYLRACFVRDIREHNRGFNNGTQQTTKCQPEMIDQTNGVLNKRSWLEQNAYFAENNCFYPFYGQAVFYASFGQHSEGRVVCCSDGRIDEEESF

SEQ ID NO: 169334 - protein, 108 aa, Heterodera glycines
  Homolog annotation: Hit_ID=NP_498046.1; Match level="QueryCoverage =39%, HitCoverage=12%, E-value=1e-11, Identity=65%"; Hit description =cyclin-like F-box and SPla/RYanodine receptor SPRY (36.8 kD) (3G27) [Caenorhabditis elegans] gb|AAA21159.
  Coding regions on vcDNA: vcDNA=SeqID_95757; Strand=+; Position=89-415
DFQEWDHQQNFLPHSHGQQGENGHHAALHCPGYLPLIGSDDQSWGWNLVNNTIAHNGEFVERYPRLNKRRNDGSKQRKTERTKKVIKTPTSMSLTDRGLMVYFHYTYK

SEQ ID NO: 169335 - protein, 143 aa, Heterodera glycines; identical to SEQ ID NO: 163664
  Homolog annotation: Hit_ID=CAE69837.1; Match level="QueryCoverage =95%, HitCoverage=93%, E-value=1e-25, Identity=43%"; Hit description =Hypothetical protein CBG16161 [Caenorhabditis briggsae]
  Coding regions on vcDNA: vcDNA=SeqID_95758; Strand=+; Position=32-463

SEQ ID NO: 169336 - protein, 200 aa, Heterodera glycines; identical to SEQ ID NO: 162443
  misc_feature (179)..(179): Xaa can be any naturally occurring amino acid
  Homolog annotation: Hit_ID=BAB63445.1; Match level="QueryCoverage =99%, HitCoverage=99%, E-value=1e-104, Identity=97%"; Hit description= ubiquitin 4 [Physarum polycephalum] dbj|BAB87826.1| polyubiquitin [Physarum polycephalum]
  Coding regions on vcDNA: vcDNA=SeqID_95759; Strand=+; Position=1-604

SEQ ID NO: 169337 - protein, 150 aa, Heterodera glycines
  Coding regions on vcDNA: vcDNA=SeqID_95760; Strand=+; Position=63-515
MEPSNENVNGDNVPNAALTGGHPPAEKIGCMRIARKERNLSQQPEEREKSGGTTPASASESGDSAHSEGETRVRPGATNVLAYTDLAKQTKLVYPTDAVRHCHEKPFPSKQAYTAHRTNAAQMQAHQQFQPRRFGHLKFQTREYGPLHKQ

SEQ ID NO: 169338 - protein, 156 aa, Heterodera glycines; identical to SEQ ID NO: 163281
  Coding regions on vcDNA: vcDNA=SeqID_95761; Strand=+; Position=1-471

SEQ ID NO: 169339 - protein, 158 aa, Heterodera glycines
  Coding regions on vcDNA: vcDNA=SeqID_95762; Strand=+; Position=1-474
IRTVKQKTRFAFPFFSSSIPMASAPSSDRFSSDHFFSDRSLRPQCLPNCASLSFGFVVDKLAQHCHCFSHLFECGQRIFEVSATELSPTNGFTSRVFRCEFEFGTFVGEKRMPTPKKRTMSAIAKVISLERMDTLWENFVGKKQMEKMRNSREQTEMI

SEQ ID NO: 169340 - protein, 60 aa, Heterodera glycines
  Coding regions on vcDNA: vcDNA=SeqID_95763; Strand=+; Position=2-184
RIFVQEIKVQVKCEKKSRSRSRQNRKKPGFSWTKFLNLFFQVTDVCQVFKNNLYKFKNTL

SEQ ID NO: 169341 - protein, 78 aa, Heterodera glycines; identical to SEQ ID NO: 166251
  Homolog annotation: Hit_ID=CAA74206.1; Match level="QueryCoverage =97%, HitCoverage=21%, E-value=5e-20, Identity=56%"; Hit description =serine proteinase [Heterodera glycines]
  Coding regions on vcDNA: vcDNA=SeqID_95764; Strand=+; Position=2-238

SEQ ID NO: 169342 - protein, 193 aa, Heterodera glycines
  misc_feature (103)..(103): Xaa can be any naturally occurring amino acid
  Homolog annotation: Hit_ID=NP_492809.1; Match level="QueryCoverage =98%, HitCoverage=56%, E-value=7e-39, Identity=44%"; Hit description =proteasome Regulatory Particle, Non-ATPase-like, Multi-ubiquitin Chain Binding protein homolog, S5 (37.3
  Gene Ontology: Mol. function=proteasome endopeptidase activity; Cellular component=proteasome regulatory particle (sensu Eukarya); Biological process=proteolysis and peptidolysis
  Coding regions on vcDNA: vcDNA=SeqID_95765; Strand=+; Position=3-585
GLLSLADRIDVLNSLTTEDRKLMVRLHSLEILGVSKVFDGIRTAYLALKHRKNRNHRQRIVVFLGSPLDPLLEEKETFIKFAKKLKKEKVSVDLVLFGEATAXNNNIIADFVDLLNGAEEGNSHLLVVMGGDTKLDDVLLRSPIFAGSGAALGAGGEFGINEEDDPELAMALRISLEEQRLRQQQQQGGEGTD

SEQ ID NO: 169343 - protein, 194 aa, Heterodera glycines
  Homolog annotation: Hit_ID=NP_506709.1; Match level="QueryCoverage =91%, HitCoverage=61%, E-value=9e-24, Identity=36%"; Hit description =ubiquitin-specific protease otubain (32.3 kD) (5P547C) [Caenorhabditis elegans] emb|CAB02772.1| Hypotheti
  Coding regions on vcDNA: vcDNA=SeqID_95766; Strand=+; Position=61-642
MDPSAVSSSSSTDQQQNAEEAQKGDLTLAQQIAEDKQKMFERSQQYQQEIEDEIRKTQPLVSSKQNIVHLVGEFDEKTSSQYFKKATELAGVYSDIRRIRGDGNCFYRAVLTAQLERCFEDAEELKRFNELVKGWRARLMAVGCFPELTTGDFCDSMEQLMTSLLNGTMLPQILLDDLNKDGIADYYVVFIRLM

SEQ ID NO: 169344 - protein, 198 aa, Heterodera glycines
  Coding regions on vcDNA: vcDNA=SeqID_95767; Strand=+; Position=49-642
MISFRHSVNKCLLPQITNRLTSNLSAMCLSTAAADNKVVSKYDDYQKEMRLKQIERAFDEAMPKLLHGSYNNLMAFLDTNSFRFEDKVWLFESDSIHKTVFRMAKVRLYLAFKSPHNRFETLGTHICLDENLVTLIWQLSWPKDAKSAYLLSPKSLAANFSATFTGGPRSQIGRIEHKLATSESSDRPPSNATTQNGR

SEQ ID NO: 169345 - protein, 66 aa, Heterodera glycines
  Coding regions on vcDNA: vcDNA=SeqID_95768; Strand=-; Position=302-502
LGLSPLTSRFLGREVKMHAFLHTAWEQGHFFECFSCKIFGLLQFCVHFSFFNRFQVSLAYFNYGLL

SEQ ID NO: 169346 - protein, 136 aa, Heterodera glycines
  Homolog annotation: Hit_ID=CAE62157.1; Match level="QueryCoverage =53%, HitCoverage=14%, E-value=9e-20, Identity=61%"; Hit description =Hypothetical protein CBG06204 [Caenorhabditis briggsae]
  Coding regions on vcDNA: vcDNA=SeqID_95769; Strand=+; Position=54-461
MCGCPTSANVVHSSPEPPTEKSAELANSSISRSVGNISTSPAKGLACSLSVNQTFKLVGIGCCLTCITNFPSAFMHTSVNTAVMELNSYLNESYTNRGTQLTDQHFSLLRSAINSCWYAGQIVGALCSPRLCDKYG

SEQ ID NO: 169347 - protein, 249 aa, Heterodera glycines
  misc_feature (60)..(60): Xaa can be any naturally occurring amino acid
  Homolog annotation: Hit_ID=NP_497830.1; Match level="QueryCoverage =55%, HitCoverage=61%, E-value=2e-43, Identity=57%"; Hit description =RiNg Finger protein (24.9 kD) (rnf-5) [Caenorhabditis elegans] emb|CAA86745.1| Hypothetical protein C16C1
  Gene Ontology: Mol. function=zinc ion binding; Biological process =embryogenesis and morphogenesis
  Coding regions on vcDNA: vcDNA=SeqID_95770; Strand=+; Position=3-750
MNSSEETTENVGIGGNKDERQTTSKDETDESSSENQRNEQRQRQMDSEKEDSRFECNICXDMAKDAVVSMCGHLFCWPCLFQWMDTRPYRQLCPVCKSAISKDKVIPLYGRGGGDSDPREKIPPRPQGQRTEETNQGFPGMFHWGGDNGGHGGGGVQFSTPISLWPTNFVRHGSAMSILCLGKVADVYLIDEPSAYLDFEQRLHAAKGIKRKKSGFIVEHDFIMSTYLADRVIVFDGPQPLVNGMNRFL

SEQ ID NO: 169348 - protein, 187 aa, Heterodera glycines
  Homolog annotation: Hit_ID=NP_491655.1; Match level="QueryCoverage =93%, HitCoverage=40%, E-value=2e-18, Identity=28%"; Hit description =WD repeat domain 12 (49.0 kD) (1G224C) [Caenorhabditis elegans] gb|AAB37809.1| Hypothetical protein F55F8
  Gene Ontology: Cellular component=nucleus; Biological process=N signaling pathway
  Coding regions on vcDNA: vcDNA=SeqID_95771; Strand=+; Position=55-615
MVAAPDEAQFHISFYTDEEECKNLLPAESINVPASSHSDQLNVLINQIGSMNDDSWKPVQFDFLLHSVLLRCSLLELVEQQQLSLENVLRIECIRQSPAPRPTAELNEAQWVADLRTLSHNCVLSVNFAGLLNVWELAGEWTRAVVKQLDDEPLKCVDTFTRDDGTTFALSGGQNQTLTLVRLRAQN

SEQ ID NO: 169349 - protein, 152 aa, Heterodera glycines
  Homolog annotation: Hit_ID=AAH75329.1; Match level="QueryCoverage =73%, HitCoverage=49%, E-value=4e-09, Identity=30%"; Hit description =MGC89012 protein [Xenopus tropicalis] ref|NP_001004905.1| MGC89012 protein [Xenopus tropicalis]
  Coding regions on vcDNA: vcDNA=SeqID_95772; Strand=+; Position=7-462
MSSIEFSLPVFCSPTQLNFVIGKRDLCESKPIQIFNPYNHLLRFKFFSNAPERWRVENAQGGIRANNYVTTTVQLREPHTIRQPTSDCLRVEIFRDGESVAVGRKDILLNILTVEPPSSSVDGANFVEFSDGTDAALNSTAQRGEAKLRTNS

SEQ ID NO: 169350 - protein, 144 aa, Heterodera glycines
  Coding regions on vcDNA: vcDNA=SeqID_95773; Strand=+; Position=2-436
SSPRWRPLFNSGSPGLQVPGTRICSNFNMNFPSRTRTQLVTDCIDYSNEIEGIIRAVPLIWQRFEEASKFFRVINKFVGYFPPLRDSFPTPGNETLDEILRCAGVGVRLLVEAESVSDYSLSNLRGALFAIYYSAVYYMPTTDD

SEQ ID NO: 169351 - protein, 160 aa, Heterodera glycines
  Coding regions on vcDNA: vcDNA=SeqID_95774; Strand=+; Position=44-526
MGNCKPADATESENASSVETVEVEVPPDPLVNPFWKMQKAFEKKLRNLLKREKKLLQLKEERDSDKPITTDQHEALSKLDEVKTLIGFVDEMMKLNQQQFSQYKKAIKNRERQLKMEKARSQIGTPQLSDELKKSTEVQTNGVAEEVQAAVGVVGPSSEV

SEQ ID NO: 169352 - protein, 60 aa, Heterodera glycines
  Coding regions on vcDNA: vcDNA=SeqID_95775; Strand=+; Position=3-185
QAEAEAERAMDNNQMTAEYQARWFKKVQDSHTGSVIHVVRDEEYWRCKINRDWSRCPEIF

SEQ ID NO: 169353 - protein, 93 aa, Heterodera glycines; identical to SEQ ID NO: 162429
  Coding regions on vcDNA: vcDNA=SeqID_95776; Strand=-; Position=11-292

SEQ ID NO: 169354 - protein, 82 aa, Heterodera glycines
  Coding regions on vcDNA: vcDNA=SeqID_95777; Strand=+; Position=10-258
CCQLLSVPFSLPQFIDKLGHSLATFRASSTLRICTTLISPKRSVNQEIRISCMTTENHRRHNQQFPCALRALPCRFCPPDAS

SEQ ID NO: 169355 - protein, 156 aa, Heterodera glycines
  Homolog annotation: Hit_ID=XP_416776.1; Match level="QueryCoverage =83%, HitCoverage=8%, E-value=6e-16, Identity=35%"; Hit description =PREDICTED: similar to cofactor required for Sp1 transcriptional activation, subunit 2, 150kDa; human homol
  Gene Ontology: Mol. function=transcription co-activator activity; Biological process=regulation of transcription from Pol II promoter
  Coding regions on vcDNA: vcDNA=SeqID_95778; Strand=+; Position=12-479
MPAPLAVQQKMISEDGSDANIPQQHFSANGTPQQPPSATVPPAAAAAHLLKNSLSAPLLANLPPVPPQCGPPTVSLALLIDFAIHWNYRQFEILSELNSKKKETDRKISVVEFAHNTRLIFVRLLAIVRWLKSAKKFEPLASIRHLLDEQATRYVE

SEQ ID NO: 169356 - protein, 159 aa, Heterodera glycines
  Homolog annotation: Hit_ID=CAE60494.1; Match level="QueryCoverage =50%, HitCoverage=14%, E-value=2e-26, Identity=64%"; Hit description =Hypothetical protein CBG04112 [Caenorhabditis briggsae]
  Gene Ontology: Mol. function=frizzled receptor activity; Cellular component=integral to plasma membrane; Biological process=signal transduction
  Coding regions on vcDNA: vcDNA=SeqID_95779; Strand=+; Position=1-477
PFWFFFRCFSAPPLLSPTFPNWAIRPRVSRPSLTGSRSAETHGKGKLRRRRLPKSDGAKLKRIISKLGYQRFSPQAPLCHPIDISLCRDIPYNRTILPNPFIDGLDPQSLQAQTEHFKPLIRTKCSPHILFFVCSVFVPMCPAQLPQAVTSCRSVCEEV

SEQ ID NO: 169357 - protein, 156 aa, Heterodera glycines; identical to SEQ ID NO: 163267
  Homolog annotation: Hit_ID=CAA92962.1; Match level="QueryCoverage =71%, HitCoverage=14%, E-value=5e-21, Identity=48%"; Hit description =Hypothetical protein F56H11.1c [Caenorhabditis elegans] emb|CAA92483.1| Hypothetical protein F56H11.1c [Ca
  Coding regions on vcDNA: vcDNA=SeqID_95780; Strand=+; Position=1-471

SEQ ID NO: 169358 - protein, 247 aa, Heterodera glycines
  Homolog annotation: Hit_ID=NP_502782.1; Match level="QueryCoverage =91%, HitCoverage=82%, E-value=7e-60, Identity=51%"; Hit description =ribosomal protein S7 (4P532) [Caenorhabditis elegans] emb|CAC70123.1| Hypothetical protein Y57G11C.34 [Ca
  Coding regions on vcDNA: vcDNA=SeqID_95781; Strand=+; Position=108-851
MLLRPCPSLPLLSNALSFVVHLPFHQQKTISTSVFALTVFDPRIFTEPIVSTEELNKPLPPNDKRNYMYLKPMLFDQTPVFYRDEIVDKMVRVFLMEGKKELSRVNVLSALEIVKRTQYEKWLNEKDEKRRAEIILDPIEVANRAILNCRPLMKLEKTIKAGTLYLVPMPISEKVAIFKAMKTMRDICRLKAGKKRNEKRPHYPHFKDVLASELLAAMENEGLTIQAKQELHKMCEQNRSYSSMKKF

SEQ ID NO: 169359 - protein, 213 aa, Heterodera glycines; identical to SEQ ID NO: 163266
  Homolog annotation: Hit_ID=CAE59942.1; Match level="QueryCoverage =92%, HitCoverage=96%, E-value=9e-31, Identity=43%"; Hit description =Hypothetical protein CBG03429 [Caenorhabditis briggsae]
  Coding regions on vcDNA: vcDNA=SeqID_95782; Strand=+; Position=77-715

SEQ ID NO: 169360 - protein, 211 aa, Heterodera glycines
  Homolog annotation: Hit_ID=AAM34784.1; Match level="QueryCoverage =87%, HitCoverage=56%, E-value=1e-54, Identity=53%"; Hit description =HDA2 [Arabidopsis thaliana]
  Gene Ontology: Mol. function=transcription factor binding; Cellular component=cytoplasm; Biological process=chromatin modification
  Coding regions on vcDNA: vcDNA=SeqID_95783; Strand=+; Position=27-659
MCASAALSAFAFLDDSEAEIDWDERCPIVYSEDYNISFFGIEKCHPFDSNKWASGALVESAVLRPIEAKKEHLLLVHSKKYLRSLNGRFTLTRILEVGLVLLFPICLIDRRILRPMRIQTGGTVLAARVSLIRGWAINIGGGFHHASEGKGGGFCVYADVTLAIKLLFANELIKSAMIVDVDAHQGNGHETDFASDSRVYILDLFHASIYP

SEQ ID NO: 169361 - protein, 93 aa, Heterodera glycines; identical to SEQ ID NO: 166234
  Coding regions on vcDNA: vcDNA=SeqID_95784; Strand=+; Position=3-284

SEQ ID NO: 169362 - protein, 237 aa, Heterodera glycines; identical to SEQ ID NO: 163264
  Homolog annotation: Hit_ID=NP_496366.1; Match level="QueryCoverage =73%, HitCoverage=90%, E-value=2e-38, Identity=51%"; Hit description =C.Elegans Y-box (21.3 kD) (cey-1) [Caenorhabditis elegans] emb|CAB04257.1| Hypothetical protein F33A8.3 [
  Gene Ontology: Mol. function=transcription factor activity; Cellular component=nucleus; Biological process=transcription from Pol II promoter
  Coding regions on vcDNA: vcDNA=SeqID_95785; Strand=+; Position=38-751

SEQ ID NO: 169363 - protein, 155 aa, Heterodera glycines; identical to SEQ ID NO: 163261
  Coding regions on vcDNA: vcDNA=SeqID_95786; Strand=+; Position=93-557

SEQ ID NO: 169364 - protein, 158 aa, Heterodera glycines
  misc_feature (128)..(128): Xaa can be any naturally occurring amino acid
  Coding regions on vcDNA: vcDNA=SeqID_95787; Strand=+; Position=3-476
IKNFKYSYLLQMSDCMTDDDAEEALRQFAEITNTDEAFAHFILQDVNFDLDRALARYYTADDPEASYKKFQTEGLDSAQNTGSEVDDEEGSGGTPNDKSKGKQPPHKRSRHEDESKESSKFPAELTLXHLECGRDGRTQFEQTILCGALHNCKNEPRS

SEQ ID NO: 169365 - protein, 335 aa, Heterodera glycines
  Homolog annotation: Hit_ID=CAE70071.1; Match level="QueryCoverage =94%, HitCoverage=99%, E-value=1e-131, Identity=71%"; Hit description= Hypothetical protein CBG16511 [Caenorhabditis briggsae]
  Gene Ontology: Mol. function=electron transporter activity; Biological process=nucleotide-sugar metabolism
  Coding regions on vcDNA: vcDNA=SeqID_95788; Strand=+; Position=61-1068
MTKKGDDESGGEAAAAIRVLVTGGTGLVGSAIRQVVTEEEQQQKPQRLQEQWFFVGSSECDLTDLEQTRALFRRVRPTHVVNLAAMVGGLFHNLRHNLQFFVKNLAICQNVLQCCHETDVERCVSCLSTCIFPDKTPYPIDETMVYNGPPHDSNFGYSYAKRMIDVLNRGYAQEHNRKYTSAVPCNIFGPRDNYNLENAHVVPALIHKCFLAKRDGGPLVVAGSGKPLRQFIYSLDLGRLFVWAIREYEDVEPIILSVDPSDEVTITDVVTAIVKAMQFKGEVIFDTTKADGQYKKTSSNAKLRARLPDFKFTPFERAIAESVQWFEANYEKARK

SEQ ID NO: 169366 - protein, 160 aa, Heterodera glycines
  Coding regions on vcDNA: vcDNA=SeqID_95789; Strand=+; Position=1-480
HNSTNLMELLSQQSAKSAAPVDGPQKLWHQINDENGTEACDRHNNGRRCCFCLDCRRRHCSFTISPIDGMEWLQQCHPSYGVDADLSAKRFLEEKKLNLSRRFQLIERGYVLKLKNDDGEGPGGGKAQRRRCSKCGCKGSLFDQLTVRLIAGSEIENEGK

SEQ ID NO: 169367 - protein, 146 aa, Heterodera glycines
  Homolog annotation: Hit_ID=CAE74779.1; Match level="QueryCoverage =96%, HitCoverage=23%, E-value=5e-40, Identity=51%"; Hit description =Hypothetical protein CBG22609 [Caenorhabditis briggsae]
  Gene Ontology: Mol. function=actin binding; Cellular component=actin filament; Biological process=cell organization and biogenesis
  Coding regions on vcDNA: vcDNA=SeqID_95790; Strand=+; Position=2-442
NDSRVHLYDLPANGGAFVEKKVLQHAGAITSVNFSPNGKYLVATDIARKVVPYSVDDGFKVASEKEWSFHTARINCCAWSSNSRYIATGSLDTNVMVWDLQQSGEHPLVIRGAHSMSAINGVAWLSDNRLLTVGQDSNVKQWTLKL

SEQ ID NO: 169368 - protein, 411 aa, Heterodera glycines
  Homolog annotation: Hit_ID=CAE64356.1; Match level="QueryCoverage =96%, HitCoverage=98%, E-value=5e-72, Identity=38%"; Hit description =Hypothetical protein CBG09043 [Caenorhabditis briggsae]
  Gene Ontology: Mol. function=DNA binding; Cellular component=nucleus; Biological process=induction of apoptosis by extracellular signals
  Coding regions on vcDNA: vcDNA=SeqID_95791; Strand=+; Position=13-1245
MIPDSAYIEIMKNCSKWNSRTMGGRTRSQTAVFDQQTGIVHRPTEHLFRHPSERCRAQNPMQVFTYPPVRWVKPKNNPSAGIEMNYFMRANPSLKSAISSSVEQPQNASSGEQQIAEAQQQIGTNVPSVRSATGGSGTKSYIENELDLAEYDLDELETNDQSDEEDWGASRKKRKKTGPGFGGNVPGRTARKVPSNISSATAKKEQPTDNGSNGGTPTAANVIGGGAGVATTATETRPYVCQLCGAKYKSRPGLAYHKLHVHQSDSNNETPKSPIISPKVQVSEYCDFCLGTNLQNAEGEAEPLISCHDCGRSGHPTCLKFTKNMLVSTKRYGWQCIECKSCAICGTSENDDQLLFCDDCDRGFHLYCLKPPLKEAPETDWSCHLCVKEFGAEASIAKATKSTEDGTSSPA

SEQ ID NO: 169369 - protein, 109 aa, Heterodera glycines
  misc_feature (15)..(15): Xaa can be any naturally occurring amino acid
  Homolog annotation: Hit_ID=NP_509736.1; Match level="QueryCoverage =100%, HitCoverage=26%, E-value=3e-36, Identity=57%"; Hit description= cathepsin L-like cysteine proteinase family member (45.7 kD) (XK958) [Caenorhabditis elegans] emb|CAA890
  Gene Ontology: Mol. function=cathepsin S activity; Cellular component= lysosome; Biological process=proteolysis and peptidolysis
  Coding regions on vcDNA: vcDNA=SeqID_95792; Strand=+; Position=2-329
APFINPDEQSMIDWXLINFGPINVGISVPPDMKPYKSGIYHPSDFDCQFKVVGLHSMLVVGYGENIYGDKYWIVKNSWGQKWGQEHGYLNFARGVNACGIEDEPIGLMA

SEQ ID NO: 169370 - protein, 160 aa, Heterodera glycines
  Coding regions on vcDNA: vcDNA=SeqID_95793; Strand=+; Position=2-481
TQIKMFFLCPPIVLLPLTLFCVASHGLTNHSKAFGNESESNRTDFFGTEPMEIPRHKSADGFDPMVDDVFALLSAGEEGEEEGNGTKVGITVEEEEEEEEQQLLLRCADQLSPFVPLLLVPPHYHRWDFSCHFQGNQSEKPADLSPNNANENADLFLKMS

SEQ ID NO: 169371 - protein, 161 aa, Heterodera glycines
  Homolog annotation: Hit_ID=CAE61308.1; Match level="QueryCoverage =91%, HitCoverage=34%, E-value=1e-53, Identity=59%"; Hit description =Hypothetical protein CBG05143 [Caenorhabditis briggsae]
  Gene Ontology: Mol. function=peroxidase activity; Cellular component =extracellular space; Biological process=protein targeting
  Coding regions on vcDNA: vcDNA=SeqID_95794; Strand=+; Position=1-483
IRQSTFNHQKALKNLTAIKEYVAHLEHFFDSPQMKEHLKTLESFPEAQLPRNFDARDKWPMCPSIHAVPNQGGCGSCYAVSAMGVAADRTCIHTNGTDGTQLSALDVIECCEVCGNCFGGDPLKAMVYWALEGVVSGGPDGCRPYAVSSACGTPCTPNLYA

SEQ ID NO: 169372 - protein, 135 aa, Heterodera glycines
  Homolog annotation: Hit_ID=CAE63553.1; Match level="QueryCoverage =98%, HitCoverage=21%, E-value=2e-60, Identity=79%"; Hit description =Hypothetical protein CBG08039 [Caenorhabditis briggsae]
  Gene Ontology: Mol. function=neurotransmitter:sodium symporter activity; Cellular component=integral to plasma membrane; Biological process=protein folding
  Coding regions on vcDNA: vcDNA=SeqID_95795; Strand=+; Position=3-410
RTVENFCTHARRGYYNGHAFHRVIKSFMIQTGDPTGRGTGGQSIWGGDFEDEFHPALRHDKAFRVSMANAGPNTNGSQFFITICPAEWLDGKNTIFGQVVEGFNVVQKINQVPVYEKSGRPREEISIISISLKSV

SEQ ID NO: 169373 - protein, 39 aa, Heterodera glycines
  Coding regions on vcDNA: vcDNA=SeqID_95796; Strand=+; Position=3-119
MDNYKVNPKDIGFLAVGTETLVDKSKSVKSVLMDLFADS

SEQ ID NO: 169374 - protein, 105 aa, Heterodera glycines
  Coding regions on vcDNA: vcDNA=SeqID_95797; Strand=-; Position=91-408
LINDQSDGVLYISKNGDFCNFKFAGPFKIACSPSPFLPRKDRDRSMAKMSGQWHFGRSVPKDVLAIGFSFVPSLFFFLLFIIRHFLLPLTFVCLFSPHYFFFRLN

SEQ ID NO: 169375 - protein, 86 aa, Heterodera glycines
  Coding regions on vcDNA: vcDNA=SeqID_95798; Strand=+; Position=46-306
MKPSFNFNLFASVFLVLCVVSLVLCEHKRAAAAEACNPPKDVGTGNLALKRWWWDGHSCKQFIYKGQGGNTNNFPSKKHCVQVCKP

SEQ ID NO: 169376 - protein, 216 aa, Heterodera glycines
  Homolog annotation: Hit_ID=CAI11846.1; Match level="QueryCoverage =91%, HitCoverage=95%, E-value=8e-17, Identity=27%"; Hit description =novel protein (zgc:55718) [Danio rerio]
  Coding regions on vcDNA: vcDNA=SeqID_95799; Strand=+; Position=69-719
MSSHCKTLEEDEEWMANLHFVRSDIDPATVKPIDSRQLASLVNEFLLRSADILNRFCAQFENRMMELDFRLDTFERMLALMERKLENVNVDEVKKQSAEEKETAEKAEGMTRKEKGEETPEGTGEEKRTDKRQGKETAAEGTTKANEHPKLAKYFKMLKMGVPEAAVRQKMRSEGMDDALLNDPEKELPLESPQNKAQMVHDALAEDDESSSNSDE

SEQ ID NO: 169377 - protein, 207 aa, Heterodera glycines
  Coding regions on vcDNA: vcDNA=SeqID_95800; Strand=+; Position=19-639
MSDHFWDENVFDLIVELEKEGRHVRLDWLSSNSALVDRFQTDIARLSEEEYSLYAASSSKLQRIAAAECAYKYNRTEELDKLFEKDRDSEALRETNVRHFLINRILDEFRPNIRRLSALPIERTIDAFCLNQPKDIEQHVLDVYDFLMDCLELRPPISADLRWLWICVVTGDQADQNDDGQVRDNVRKFIDKCCNIFRNDVRSDQYK

SEQ ID NO: 169378 - protein, 87 aa, Heterodera glycines
  Coding regions on vcDNA: vcDNA=SeqID_95801; Strand=-; Position=1-261
KRMDEKYIKNGQINANEKAKKRERKYELMRVQQNAMGCPKNPLGQVDSNPSQTIVFGPAQRSSVAPPTHRSPPIAALYCPPLSMIRT

SEQ ID NO: 169379 - protein, 146 aa, Heterodera glycines
  Homolog annotation: Hit_ID=CAE63047.1; Match level="QueryCoverage =82%, HitCoverage=20%, E-value=5e-28, Identity=49%"; Hit description =Hypothetical protein CBG07318 [Caenorhabditis briggsae]
  Coding regions on vcDNA: vcDNA=SeqID_95802; Strand=+; Position=37-474
MVHKQNQLETTAVPIAVAHNDNGTADIFEQFEIMFNGDKSVFFGNETVTGSLKIKLKQETVLNAIHLHFICVAKWIGTGRKEDKEGQTEKIYFDKNFVLLERPPGHPGPGHFKFVAHFAYSLPFECPLPSGCETSYESGSAHIRYF

SEQ ID NO: 169380 - protein, 128 aa, Heterodera glycines
  Coding regions on vcDNA: vcDNA=SeqID_95803; Strand=-; Position=3-386
RLLSSLSAALLVDDHVYDVDAHPSRLPRVRPLVLRSPPVASVLLVYEHIGNVRRAATARGRRTNATAVTAIGTAAVFSAFNALRHINFVFLQMNGRKNNGHQNEQKKDHWVRWIHIAKRELKRRSAQG

SEQ ID NO: 169381 - protein, 102 aa, Heterodera glycines; identical to SEQ ID NO: 163248
  Coding regions on vcDNA: vcDNA=SeqID_95804; Strand=-; Position=121-429

SEQ ID NO: 169382 - protein, 113 aa, Heterodera glycines
  Homolog annotation: Hit_ID=CAG10857.1; Match level="QueryCoverage =99%, HitCoverage=17%, E-value=1e-14, Identity=41%"; Hit description =unnamed protein product [Tetraodon nigroviridis]
  Gene Ontology: Mol. function=heterogeneous nuclear ribonucleoprotein; Cellular component=nucleus; Biological process=mRNA processing
  Coding regions on vcDNA: vcDNA=SeqID_95805; Strand=+; Position=1-339
HGKVDKVKRIKDYAFVHFEERSAAVQAMEALKNTEVDGAPMEVSLAKPQGDQNQKKKLAIKSRFNPQQYGAGVTPGIGPRGRKGYEYMGAFRGGRGGAGPSMHMGYHQPYPGY

SEQ ID NO: 169383 - protein, 161 aa, Heterodera glycines
  Homolog annotation: Hit_ID=CAE59601.1; Match level="QueryCoverage =85%, HitCoverage=37%, E-value=1e-31, Identity=47%"; Hit description =Hypothetical protein CBG03009 [Caenorhabditis briggsae]
  Coding regions on vcDNA: vcDNA=SeqID_95806; Strand=+; Position=2-484
FNNLSSKFLKNGPFTKVALPFFSRFCFSTEAFEKAQKDMKQLKDEPDNDTKLELYALFKQANEGDVRGDRPKMLEFVARAKFFAWEKVKGMPKADAQHKYAEIVNSLLKNAGINNANTSETESDGIRRTKEGKVYKIELNRSDKYNAITWEMYEGLISALG

SEQ ID NO: 169384 - protein, 36 aa, Heterodera glycines
  Coding regions on vcDNA: vcDNA=SeqID_95807; Strand=+; Position=3-113
LIQINNSNLRRIKLISRLKNRRTVLKRKKTKNFTYL

SEQ ID NO: 169385 - protein, 146 aa, Heterodera glycines; identical to SEQ ID NO: 162387
  Coding regions on vcDNA: vcDNA=SeqID_95808; Strand=-; Position=36-476

SEQ ID NO: 169386 - protein, 309 aa, Heterodera glycines
  misc_feature (99)..(99): Xaa can be any naturally occurring amino acid
  misc_feature (110)..(110): Xaa can be any naturally occurring amino acid
  Homolog annotation: Hit_ID=NP_506170.2; Match level="QueryCoverage =98%, HitCoverage=62%, E-value=3e-72, Identity=50%"; Hit description =putative nuclear protein of eukaryotic origin (47.8 kD) (5N183) [Caenorhabditis elegans] emb|CAA99907.2|
  Coding regions on vcDNA: vcDNA=SeqID_95809; Strand=+; Position=27-949
MSVSWGTQYSKLKTNLRLAANRLRLLQKKKTEQAVKARCEIADFLSTDKEDRARIRVETIIREDFVVEAYELLEMYCELLLARFGIIQQMKELDDGIAXEAVSSLLWVAXPRIGHEIAEFKVINDELTHKYGKQFAEAARMNQLPEPSRVSTKLVQKLSVSAPSKLLVEKYLVTIAQSAGVDFAPDAKVMREDDDEIARAERNLINFMNEEQYGWTVRHNDDPNSKGSGGGHFAAAVAGAVGPADPLMNQGSNNNNGGGATAMPMPPNGSGAFAMSPSTFVPSHPSPLATSSSPPPEYAPPPPLPAHGA

SEQ ID NO: 169387 - protein, 92 aa, Heterodera glycines
  Coding regions on vcDNA: vcDNA=SeqID_95810; Strand=-; Position=3-278
LSIIFPYFSNFLHIHSNSSTQNAVVPKASFLAHFLNPFGHILNRPFITTLPFSSVRLPTPTLQLLLDFFIAIETGSIKILMNKKKKIKANID

SEQ ID NO: 169388 - protein, 161 aa, Heterodera glycines
  Coding regions on vcDNA: vcDNA=SeqID_95811; Strand=+; Position=7-492
GINITFVAMLPSNLFFLLMTMLSSSLLHQTLANKFSAETDAVNPTRLIQRRHLIRSRAIHKEKMHSNVNEGYLQWEKDKFHEALGEKCGKKSNWEQRDFGILRILPKSSRSLMDPKFLGSVEPRLLKTSADGTRTKSDSEEEKWRNWLRRHFPAARTISDQ

SEQ ID NO: 169389 - protein, 87 aa, Heterodera glycines
  Coding regions on vcDNA: vcDNA=SeqID_95812; Strand=-; Position=61-324
VEQCRATTTTASNGCDVMKTVGRSAPLLLLFLVGLFGVQTSCWVPSFLLYSIRPICGHSTATFKQIWTRRIRTNNGTSFSSFLFVEH

SEQ ID NO: 169390 - protein, 209 aa, Heterodera glycines
  Homolog annotation: Hit_ID=NP_543138.1; Match level="QueryCoverage =97%, HitCoverage=76%, E-value=2e-71, Identity=59%"; Hit description =SPRY domain-containing SOCS box protein SSB-4 [Homo sapiens] dbj|BAB71165.1| unnamed protein product [Hom
  Coding regions on vcDNA: vcDNA=SeqID_95813; Strand=+; Position=43-669
MHPYEFKLDAILSRSELPVEKLEKHAWNPEDRSLNLYVKEEDVLTMHRHPVAQSTDGMRGKVGYTRGFHVWQLNWPVNQRGTHAVVGVATKDAPLHAPGYVSLIGADAEGFGWNIVENKCYHDAQNTKPWSFPYEQPFVAPEKLFCVLDMDEGQLAFATDSKYLGVAFRGLKGKKLYPAVSAVWGHCEITLRYLGGLDPDSHLMDTCRR

SEQ ID NO: 169391 - protein, 168 aa, Heterodera glycines
  Coding regions on vcDNA: vcDNA=SeqID_95814; Strand=-; Position=0-503
ISSTCHFGDRWMIDDLPAALRGAGKKHPQQFGKSDLVRRQLQSGPIGFGFETPPHRGFFDGAATSKGCTPPIGTGSCGKHPQPTRNLLTLYTTVIAYLTVDYLFSLFLSICFQKKLGNFLIFSFFSCKGAKATKEIQIQLRDLSYKQFKVRFLGTKQNANLQNAIKGS

SEQ ID NO: 169392 - protein, 155 aa, Heterodera glycines
  Homolog annotation: Hit_ID=EAK85491.1; Match level="QueryCoverage =98%, HitCoverage=50%, E-value=2e-60, Identity=75%"; Hit description =hypothetical protein UM04634.1 [Ustilago maydis 521] ref|XP _402249.1| hypothetical protein UM04634.1 [Usti
  Gene Ontology: Mol. function=rRNA binding; Cellular component =ribosome; Biological process=protein biosynthesis
  Coding regions on vcDNA: vcDNA=SeqID_95815; Strand=+; Position=19-483
MVFVKAVKNKAYFKRYQVKYRRRREGKTDYYARKRLVTQAKNKYNSPKYRLVVRITNADVICQIVYSKIQGDFVLTAAYAHELPRYGVKVGLTNWAAAYATGLLVARRALKKLSLDDKYEGFVNPDGTIAEVEPLEDGPRPFKAFLDVGLARTTT

SEQ ID NO: 169393 - protein, 159 aa, Heterodera glycines
  Homolog annotation: Hit_ID=CAE70897.1; Match level="QueryCoverage =92%, HitCoverage=51%, E-value=2e-31, Identity=40%"; Hit description =Hypothetical protein CBG17688 [Caenorhabditis briggsae]
  Coding regions on vcDNA: vcDNA=SeqID_95816; Strand=+; Position=31-507
MLSRSPEMEEERLPIVSMVIVADKSRAPANFITLTKTYDDGSDADLWKDGFGFGLFNRSVRYIAVSRHIAETPPSGLEVLTDVAVISDKEAVPSSFVCLDFTVDTKERALKKKYLCARFTPRTDAIDAVTNLIVLARSRRPPKGYTLAGDIDGMAICFR

SEQ ID NO: 169394 - protein, 199 aa, Heterodera glycines; identical to SEQ ID NO: 164031
  Homolog annotation: Hit_ID=AAH77441.1; Match level="QueryCoverage =97%, HitCoverage=99%, E-value=2e-12, Identity=26%"; Hit description =Unknown (protein for MGC:82284) [Xenopus laevis]
  Coding regions on vcDNA: vcDNA=SeqID_95817; Strand=+; Position=34-633

SEQ ID NO: 169395 - protein, 163 aa, Heterodera glycines
  misc_feature (71)..(71): Xaa can be any naturally occurring amino acid
  Homolog annotation: Hit_ID=CAE64112.1; Match level="QueryCoverage =98%, HitCoverage=59%, E-value=9e-38, Identity=49%"; Hit description =Hypothetical protein CBG08721 [Caenorhabditis briggsae]
  Gene Ontology: Cellular component=cytoplasmic vesicle; Biological process=signal transduction
  Coding regions on vcDNA: vcDNA=SeqID_95818; Strand=+; Position=3-493
SFSVDLEQLEKEIQAKEAASKRDNVTDTKVQPDLKGNIGSGTSAQTKRKSNVVGLEEDFDTLDEPICDTLXRDLKILYGKFSQVLFPAKSEQNVLTDWDLWGPLFICVALSILLQGADRGAQFTQIFSLAFFGTCIVTLNAKLLGGKISFFQALCVIGYCLLP

SEQ ID NO: 169396 - protein, 235 aa, Heterodera glycines
  misc_feature (190)..(190): Xaa can be any naturally occurring amino acid
  Homolog annotation: Hit_ID=NP_497892.1; Match level="QueryCoverage =82%, HitCoverage=86%, E-value=3e-80, Identity=72%"; Hit description =peroxiredoxin, thioredoxin-dependent peroxide reductase, mitochondrial (24.9 kD) (3F499) [Caenorhabditis
  Gene Ontology: Mol. function=thioredoxin peroxidase activity; Cellular component=extracellular space; Biological process=response to oxidative stress
  Coding regions on vcDNA: vcDNA=SeqID_95819; Strand=+; Position=67-769
MLTNKLAKCAAMTMTRCQPLNALAMLGGARLCHHTPPNCMDAIRPLGPKSSVPSFKGQAIVNAEMKTISYDDYKGKWLIFFFYPLDFTFVCPTEIIAFSDRVAEFKQLGCEVIACSCDSQFSHLAWVNTPRNDGGLGKMEIPVLSDFSKKIAADFGVLDKETGLSYRGLFLIDPNGTVRHCLVNDLPVGXRSVDEALRILKAFQFFEKHGEVCPADWEEGGETIDVKSPKEYFKK

SEQ ID NO: 169397 - protein, 146 aa, Heterodera glycines
  Coding regions on vcDNA: vcDNA=SeqID_95820; Strand=-; Position=3-440
FWQNRIIYWERKNRFMHLIIEIWKKGLKWGRKGGIKLKMNVYFFGIHPEFFFFFFFFTHSLHSLFTTAQNALIPSAATGTDVERCFGFLPAFVHFLVVPTGHLFIPISRNKIGANEKADNYQQKKHNETQMEHLEKAENYLKLLKA

SEQ ID NO: 169398 - protein, 159 aa, Heterodera glycines
  Coding regions on vcDNA: vcDNA=SeqID_95821; Strand=+; Position=1-477
QLSAVQPEIEQPNEGDADGEQQPAEPIQLIDKEREYLAVKAASRAVISHLSEWSTPIEMRFAMDGTVETKRKMRRRFCIDRQQMLHDIECMYAPKIGIKQILNVDIVGCQDEISQATENVYQMVYDGGFFRKQTGLCNFKVLKPTPTTKNVLDNVINGI

SEQ ID NO: 169399 - protein, 77 aa, Heterodera glycines
  Homolog annotation: Hit_ID=CAA07704.1; Match level="QueryCoverage =87%, HitCoverage=55%, E-value=2e-33, Identity=100%"; Hit description= lacZ' [Cloning vector pGreen]
  Coding regions on vcDNA: vcDNA=SeqID_95822; Strand=+; Position=287-517
KKKKKKKKKNSRGGPVPNSPYSESYYNSLAVVLQRRDWENPGVTQLNRLAAHPPFASWRNSEEARTDRPSQQLRSLN

SEQ ID NO: 169400 - protein, 54 aa, Heterodera glycines
  Coding regions on vcDNA: vcDNA=SeqID_95823; Strand=+; Position=5-169
GVTHFPFSSFLSVVITTQFQFVNSFFTHRRDDFFKIANASCDFQYCFNYCYCWP

SEQ ID NO: 169401 - protein, 133 aa, Heterodera glycines; identical to SEQ ID NO: 163234
  Homolog annotation: Hit_ID=CAA33608.1; Match level="QueryCoverage =90%, HitCoverage=81%, E-value=1e-42, Identity=67%"; Hit description =ribosomal protein [Mucor racemosus] pir||R3UD24 ribosomal protein S24 - Rhizomucor racemosus sp|P14249|RS2
  Gene Ontology: Cellular component=eukaryotic 48S initiation complex; Biological process=protein biosynthesis
  Coding regions on vcDNA: vcDNA=SeqID_95824; Strand=+; Position=7-408

SEQ ID NO: 169402 - protein, 158 aa, Heterodera glycines
  Homolog annotation: Hit_ID=XP_396497.1; Match level="QueryCoverage =91%, HitCoverage=12%, E-value=3e-34, Identity=52%"; Hit description =similar to mKIAA1601 protein [Apis mellifera]
  Gene Ontology: Cellular component=membrane
  Coding regions on vcDNA: vcDNA=SeqID_95825; Strand=+; Position=17-490
MAATSATGFPVCILTPCSNSHPFEERRILVTRTEEDAVKIGRSVVRLQPSSNNAIFDCKVLSRNHAVLWANGAGHFMIKDTRSSNGTFINNERLSASGEENEPRELFSGDILQLGVEIIDTAKKVASGCVTCIVRLLNERGEECAGRPKPDHGTFPTL

SEQ ID NO: 169403 - protein, 201 aa, Heterodera glycines
  Homolog annotation: Hit_ID=EAA10890.2; Match level="QueryCoverage =91%, HitCoverage=90%, E-value=1e-43, Identity=50%"; Hit description =ENSANGP00000017070 [Anopheles gambiae str. PEST]
  Gene Ontology: Mol. function=RNA binding
  Coding regions on vcDNA: vcDNA=SeqID_95826; Strand=+; Position=106-711
MTTEEPISGGQPNTPPIPAIELSYPVSVIYCGECSMPVEYCEYSGKFERCQQWLERNLPDLAEKQMKIGAGDGKAAEEGNGEETEAKKHQKRGGKGLPKASGGGKGSKEQSAAVPRITLKTEVRSKNKAVTVVKGLTTCGVDLKTASKFFANRFACGCSVTVGSADELVIQGDFKDKLFVEIPKKWGVDEEVIEDLDDQKK

SEQ ID NO: 169404 - protein, 206 aa, Heterodera glycines
  Homolog annotation: Hit_ID=NP_503064.2; Match level="QueryCoverage =99%, HitCoverage=34%, E-value=4e-37, Identity=40%"; Hit description =alpha amylase, catalytic domain containing protein family member (69.3 kD) (4S215) [Caenorhabditis elegan
  Gene Ontology: Mol. function=cystine transporter activity; Cellular component=integral to plasma membrane; Biological process=basic amino acid transport
  Coding regions on vcDNA: vcDNA=SeqID_95827; Strand=+; Position=22-639
MATTDGMVEDGKVGNDLQSAKFTKDKEVVDIVQPTAKLIGLTKEQLEQYRNDPFWKAIRYSLFVAFWLIWLAMFVGAVLIVVLSPKCQQVNWTEKMVAYKIFTLAYKDSESKNGFGDFEVIEKKLDQMKGIGVNAIWPTPVLKYYKNALGPEAIEKLEVSDQLGGAEGFKKLIKRAHDNQIKVIVDLPLTVNAKGNWANKTSDTKN

SEQ ID NO: 169405 - protein, 383 aa, Heterodera glycines
  Homolog annotation: Hit_ID=NP_503545.1; Match level="QueryCoverage =98%, HitCoverage=87%, E-value=1e-118, Identity=54%"; Hit description= ALDH3C2, ALdehyde deHydrogenase (48.8 kD) (alh-5) [Caenorhabditis elegans] gb|AAB94178.1| Aldehyde dehyd
  Gene Ontology: Mol. function=aldehyde dehydrogenase activity; Cellular component=integral to membrane; Biological process =acetaldehyde metabolism
  Coding regions on vcDNA: vcDNA=SeqID_95828; Strand=+; Position=16-1164
MASEDASKIVTEQRNFFKTGATRAAAFRKEQLKKMREMIVQNKDKICEAIYKDLRRNKETNMKMEVDGPLQAIDYCLSELDEWMKPQKLDDHQLGKPLVIFEPKGVVLVITAWNYPAALAFQPAIEAIAAGNTVVIKPSEVSPNTSKLLKEMFDATFDKKFIAVVEGAAPETQALLDQRFDHIFYTGSSSIAKLIMQAAAKNLTPVTLELGGKCPVVVENDADLEKAALRIAEGKWLNSGQTCLAPDYVMTTAEMKPKLVNALQKSIQTLYGENPKKSEQYSRMVNQRHFDRVKALLDKTNGKVLYKNGEPDRDDVFIPPVLVDTDLKDALMQEEVFGPVLPILTVKGLDEAMDVINDGEKPLGAYLFTNDQQKVDKFLNETS

SEQ ID NO: 169406 - protein, 160 aa, Heterodera glycines
  Homolog annotation: Hit_ID=XP_420103.1; Match level="QueryCoverage =97%, HitCoverage=13%, E-value=7e-32, Identity=45%"; Hit description =PREDICTED: similar to Transcript increased in spermiogenesis 78 [Gallus gallus]
  Coding regions on vcDNA: vcDNA=SeqID_95829; Strand=+; Position=1-480
HLDNKILTAWNALAISGFCAAAQAVPTRAAEFQKRAEKAVAFIRSHLFHGGELLRSAYLDNLGQVVQIRHPIKAFADDYAFLIEALLSLYSLNLDENLLQWAHNLQLQMDELFWDSTFDSGYFMSRVGDPSIIVRMQDEQDGAEPCTNSVAASNLLCLGF

SEQ ID NO: 169407 - protein, 118 aa, Heterodera glycines
  Coding regions on vcDNA: vcDNA=SeqID_95830; Strand=-; Position=5-361
TLSAIFLKNPDNNKKINYHIQQKLLVINQFVCSVVVAPHLSVKKFSGMTGREAESGSAKMSGIFLNNEVPFPVNIRLLMTLFILISVQREFCHVTFSYAKFSNSVDKDGNKRKCGIMP

SEQ ID NO: 169408 - protein, 116 aa, Heterodera glycines
  Coding regions on vcDNA: vcDNA=SeqID_95831; Strand=+; Position=1-351
HSLASITSTPTQSTSQNGLPFLLLPDLPPIPRDSPSRRCRLRCHLIRYLLIHGQDLGRSRLAHPSKPRPHHLGRAPQAVGGGQEALSCSAVSSSRPQPDPLHTKSTHHPTFFRLPT

SEQ ID NO: 169409 - protein, 152 aa, Heterodera glycines
  Homolog annotation: Hit_ID=NP_491749.2; Match level="QueryCoverage =96%, HitCoverage=28%, E-value=7e-15, Identity=33%"; Hit description =ariadne family member (57.3 kD) (1G636) [Caenorhabditis elegans] gb|AAB93645.3| Hypothetical protein C27A
  Coding regions on vcDNA: vcDNA=SeqID_95832; Strand=+; Position=18-473
MSNSNDSDDLIIYDDNEDIKDVSSDSGDEVAMEEVTNAGTSTAGALSNEEIRDYQVLSQTELVDELNKLSSETSAVLRFNGSICKVLLHHFKWNKVTLIERFFEFPETSNTDSFFRNANLLDPTKHTKIEGKVDYCKICYDLRQLTGLLCNH

SEQ ID NO: 169410 - protein, 211 aa, Heterodera glycines; identical to SEQ ID NO: 163229
  Coding regions on vcDNA: vcDNA=SeqID_95833; Strand=+; Position=12-647

SEQ ID NO: 169411 - protein, 172 aa, Heterodera glycines
  Homolog annotation: Hit_ID=CAE70610.1; Match level="QueryCoverage =90%, HitCoverage=40%, E-value=4e-35, Identity=50%"; Hit description =Hypothetical protein CBG17293 [Caenorhabditis briggsae]
  Coding regions on vcDNA: vcDNA=SeqID_95834; Strand=+; Position=118-633
MPSLLLNPGPSTMNFFSSSLPLPSFFFRNRKKCYDLNPPEESHQVTYLGNMLTIMGKGDTSIDRPLEVITRAWGATVAKGATRHGAGATFGQQQAQQLAMRLCVCRSGLRAETCIGVTEYFTHRITWSAAPSQYPRVFCWIYKHEGKRMKPELRCHAVLCRRADEPQQMHQT

SEQ ID NO: 169412 - protein, 140 aa, Heterodera glycines
  Homolog annotation: Hit_ID=NP_498263.1; Match level="QueryCoverage =99%, HitCoverage=26%, E-value=1e-45, Identity=63%"; Hit description =ALDH7A2, ALdehyde deHydrogenase (alh-9) [Caenorhabditis elegans] gb|AAC46640.1| Aldehyde dehydrogenase pr
  Gene Ontology: Mol. function=aldehyde dehydrogenase (NAD+) activity; Biological process=aldehyde metabolism
  Coding regions on vcDNA: vcDNA=SeqID_95835; Strand=+; Position=1-420
TFSSVGTAGQRCTSTRRLIIHEKVYDVVLERVVNAYKQLMDTRIGDPLDERTLIGPLHSRESVLKYKTAIAEAIATGGRILCGGKVLEESKGNYVLPKVITGLAHDAPVVLRETFAPIVYAVKVADFEEAVAVNNEASQG

SEQ ID NO: 169413 - protein, 153 aa, Heterodera glycines
  Homolog annotation: Hit_ID=AAS78778.1; Match level="QueryCoverage =89%, HitCoverage=89%, E-value=2e-24, Identity=43%"; Hit description =thioredoxin [Ascaris suum]
  Gene Ontology: Mol. function=thioredoxin reductase (NADPH) activity; Cellular component=nucleus
  Coding regions on vcDNA: vcDNA=SeqID_95836; Strand=+; Position=1-462
GIHPFCNIGVLRKTDDKSLMNGQLALKGCEIMALYFGAHMSQRCREFIPVLKQFYDQLKKSPDAVPFEIVFVPFDRSEDEFRNSLRDLHDDWLYIPYGSVHINSLAARFKIINWGVIPTLVVLKEDGTLITMAGEANVKYLSASEAMVRWRSL

SEQ ID NO: 169414 - protein, 153 aa, Heterodera glycines; identical to SEQ ID NO: 163223
  Coding regions on vcDNA: vcDNA=SeqID_95837; Strand=+; Position=3-464

SEQ ID NO: 169415 - protein, 131 aa, Heterodera glycines; identical to SEQ ID NO: 163218
  Coding regions on vcDNA: vcDNA=SeqID_95838; Strand=+; Position=150-545

SEQ ID NO: 169416 - protein, 216 aa, Heterodera glycines
  Coding regions on vcDNA: vcDNA=SeqID_95839; Strand=+; Position=3-650
SCRIRHEAYVFPFLFLYFKFTANFLELLHTMSAIENDETKSRIWQQLKTKLHSTMVAFGSGSVQLPKLMDTFRHDWGSELTSYAVQLGFGCNDAAVYKMLLTMPDEIESGFISATGTFAFKVIPKAETSENLTKIDQSNQYQDEMRRIFARRRSSMSSGFHRSFPFNQSFHVRPPVRMPPPPPPMPFNLSAPILNGPKFPGLVIQLPNCADAQRRV

SEQ ID NO: 169417 - protein, 65 aa, Heterodera glycines
  misc_feature (1)..(1): Xaa can be any naturally occurring amino acid
  Coding regions on vcDNA: vcDNA=SeqID_95840; Strand=-; Position=64-261
XNCYFNDKSTFFNGLINTRKCFCHKLLLSSTLTRTISTRPKLAPPHLLRARPNFQSEHWHLNGRR

SEQ ID NO: 169418 - protein, 211 aa, Heterodera glycines
  Coding regions on vcDNA: vcDNA=SeqID_95841; Strand=+; Position=3-635
LTPVGPSVAPLAFSSSSTDASAVELPYAVPNFGTPTEKLLLGGELIAVPSALLADEKIFRSVLCPKSFWSLSQASRDHLEHFLPLPSISSAIKSSSVSVARRNCGAPLDELLSCAFTSDPNFCFGNPLAKFFARIRNGYFSSPEQVQLRDHRRVLYDHYIRHYQMNLLKTLLINSHVLLEQSTMLNSFDEHVRLNPRTFCSLRKLAKHKEV

SEQ ID NO: 169419 - protein, 210 aa, Heterodera glycines
  Coding regions on vcDNA: vcDNA=SeqID_95842; Strand=+; Position=2-631
FEAYIRLDISKLITAESRMTEEMRSLVRTRNNFEVERIKLTCEQPLAQSVADAVKESEELVNVEQKPKKIPIWRRKDSELFSRPCTFLEDTRFYLLSKRQPIPAALRRNGLTSKAIDAIVKDLFGKAKSGEAKSPSPMDHKPFSAKSSTNANTAAKTPATVGKRLRKARLRKLQSANPSTSAAKLLVSLEPLNRKVPPQLRQCNFTPNYA

SEQ ID NO: 169420 - protein, 227 aa, Heterodera glycines
  Homolog annotation: Hit_ID=NP_495470.1; Match level="QueryCoverage =97%, HitCoverage=99%, E-value=2e-60, Identity=50%"; Hit description =ribosomal protein L10 (25.3 kD) (2H403) [Caenorhabditis elegans] gb|AAA82424.1| Hypothetical protein F10E
  Gene Ontology: Biological process=protein biosynthesis
  Coding regions on vcDNA: vcDNA=SeqID_95843; Strand=+; Position=51-734
MPKSKRDRVVSLTKVKKKSREGKENILKEVRECVGQYKHLFVFSTENLRSARLAEVRQHFKQNSRIFFAKNNLMAVALGKSAQDEQANELHKVSALLRGQSGLMFTNAKANEVQRFFAEHTEAEFAQAGAVASADISLPAGPMPAELHLHGAMEPQLRKLGMPTRLENGAIELLEEFTVCKTGDQLSADQARILKQFGHRLAQFRVRLLARWSKKKGFEQIDGGAEE

SEQ ID NO: 169421 - protein, 111 aa, Heterodera glycines; identical to SEQ ID NO: 166179
  Coding regions on vcDNA: vcDNA=SeqID_95844; Strand=+; Position=3-338

SEQ ID NO: 169422 - protein, 151 aa, Heterodera glycines
  Homolog annotation: Hit_ID=AAL78214.1; Match level="QueryCoverage =95%, HitCoverage=71%, E-value=1e-11, Identity=32%"; Hit description =putative esophageal gland cell protein Hgg-20 [Heterodera glycines]
  Coding regions on vcDNA: vcDNA=SeqID_95845; Strand=+; Position=25-477
MNRRWVCTDVWMDILPFFNRLQLGLKLALLSPRFDVLVDKHFDGKCELTIWRHINILKGAGPEPELSVRIDRKTMKFPLPDRPLPTKIRIKDLHIEYTDHSVITFLRANQQIFDKGIDLDLYWDDALHDNNSDDVQQIWDVFAREIWPIFA

SEQ ID NO: 169423 - protein, 129 aa, Heterodera glycines
  misc_feature (48)..(48): Xaa can be any naturally occurring amino acid
  Homolog annotation: Hit_ID=AAL78214.1; Match level="QueryCoverage =86%, HitCoverage=58%, E-value=8e-10, Identity=34%"; Hit description =putative esophageal gland cell protein Hgg-20 [Heterodera glycines]
  Coding regions on vcDNA: vcDNA=SeqID_95846; Strand=+; Position=85-472
MNRRWICNDVWMDIFPSFDRAQLGLKLALLSPRFNALVDKHFDGKSEXQFGDQSIISKDKGPEPKLSVRIDDKFVPFPFPDDRPLPSKIRFKDLRIDYIDHSVIAFLRSNHQIFDKRGINLYLWIPSPH

SEQ ID NO: 169424 - protein, 121 aa, Heterodera glycines
  Coding regions on vcDNA: vcDNA=SeqID_95847; Strand=-; Position=142-507
VLSHVLGQARALPRRLITATDVAASTNTPLVTARKTGNETTIPSQCVMCLPQQPLNDAQTPTQPLGRPTSVHPTLAQRTNQARQPATDTLPRSSHTQALTCAALSGIPQLQRMEAPQKHGS

SEQ ID NO: 169425 - protein, 253 aa, Heterodera glycines
  misc_feature (211)..(211): Xaa can be any naturally occurring amino acid
  misc_feature (218)..(218): Xaa can be any naturally occurring amino acid
  Homolog annotation: Hit_ID=CAE64717.1; Match level="QueryCoverage =97%, HitCoverage=95%, E-value=2e-74, Identity=57%"; Hit description =Hypothetical protein CBG09503 [Caenorhabditis briggsae]
  Gene Ontology: Mol. function=electron transporter activity; Cellular component=mitochondrion; Biological process=carbohydrate metabolism
  Coding regions on vcDNA: vcDNA=SeqID_95848; Strand=+; Position=12-770
MFPAKYKAFRLENKVAVITAATNGIGLAIAERLGHEGARLVVSSRDEDNVKRAIDRLVSSGLKRSDLAGCTCHVSNSEDRSRLLKLTIQRFGSVHILVNNAGINPIFGDLLDVDESAWDKLFDVNVKAGFMMAKLFAPEIEQSGGGSIVFNSSIGAYRSPQGIAAYGITKTALLGLTRALAESLAPKGIRVNAIAPGIIKTKMSKALWEGXTNGPVTXAIVTLMGRLGMPEECAALLAFFCSSDASYITGETV

SEQ ID NO: 169426 - protein, 162 aa, Heterodera glycines
  Homolog annotation: Hit_ID=CAG07650.1; Match level="QueryCoverage =95%, HitCoverage=66%, E-value=1e-13, Identity=30%"; Hit description =unnamed protein product [Tetraodon nigroviridis]
  Coding regions on vcDNA: vcDNA=SeqID_95849; Strand=+; Position=7-492
MMSSSSFEQLSCEIAELEKLRQQSQLPNVQKAIDELIGRWKVKKEEQKMKTDKGTAETLSAPTEAPKLISGSVHVRPTKKLTTYAFDESDKFVKLYYSLPGISDSVPGTISTDFRENSFSIVCSDVKGIDYEIRVQGLCQAVEPEKCVVKQKSGDQLLIMLK

SEQ ID NO: 169427 - protein, 118 aa, Heterodera glycines
  misc_feature (1)..(1): Xaa can be any naturally occurring amino acid
  Coding regions on vcDNA: vcDNA=SeqID_95850; Strand=-; Position=3-356
XIFKNFQLIEKYKSASIFLHHAIPIVRLFVPSFAWHCRQFVEGTLCQVEETVYVSWALTVGRQHVFPPFRCSIPRKICRHWPINLHILMDSLLKKNSHVWCDSRKMRRIKLSIMNFKP

SEQ ID NO: 169428 - protein, 154 aa, Heterodera glycines
  Homolog annotation: Hit_ID=NP_492063.1; Match level="QueryCoverage =66%, HitCoverage=98%, E-value=1e-21, Identity=45%"; Hit description =t-complex-associated-testis-expressed 1-like (1H876) [Caenorhabditis elegans] emb|CAA95796.1| Hypothetica
  Coding regions on vcDNA: vcDNA=SeqID_95851; Strand=+; Position=86-550
MSLQCLTQEEVNTICKDVLENLIGASTYQHTEAVKWNQSVVEKITARLVQLQKPYKYCVCVILMQTGSGAGLSVASMCFWDRRCDNSFVVRWESKAVTAVCNIFAIAVDSGAVSPVPMMDNDAATDGEGGTVAASATATTNGGDIVGGGKSECE

SEQ ID NO: 169429 - protein, 183 aa, Heterodera glycines
  Homolog annotation: Hit_ID=NP_741466.1; Match level="QueryCoverage =97%, HitCoverage=76%, E-value=9e-33, Identity=40%"; Hit description =prosaposin precursor (27.3 kD) (4J243) [Caenorhabditis elegans] gb|AAB37550.2| Saposin-like protein famil
  Coding regions on vcDNA: vcDNA=SeqID_95852; Strand=+; Position=31-579
LIILQMKLFCPFVFLVLLSATAFAFSNLNKTPKTVHWEDACDECQLIIKRVVNVATDPEKVAELKILLSALCQETSYVEECRLFVSKLDLFLGRLLPFLRDAHHVCKELRICNNGRLQQFHVLGLHFARVNASFQRKDLICEECQLAARELAREVSEPKFQQYVEEWLQGNVCVHLGTLKSSC

SEQ ID NO: 169430 - protein, 200 aa, Heterodera glycines
  Homolog annotation: Hit_ID=CAE67645.1; Match level="QueryCoverage =100%, HitCoverage=58%, E-value=2e-35, Identity=41%"; Hit description= Hypothetical protein CBG13204 [Caenorhabditis briggsae]
  Gene Ontology: Cellular component=cytoplasm; Biological process =antimicrobial humoral response (sensu Invertebrata)
  Coding regions on vcDNA: vcDNA=SeqID_95853; Strand=+; Position=30-629
MSSKRVRFTEERNATERVKRSRTEAAEEEKRERLDDEEDGGPAETAEGMKTKRTKKHTLDSDEEDETEGYQRLDMDKVEGQEESTLEYEGHVKIMPFNMKDDLEEGHFDANGTFIFDKKQSVIKDAWLDNIEWDNVKNAAGKHWGKLDDEDDKKADDEKEVEPKEVYRRLVELLNEKETIGAALKRLNNEKKSNAAEERK

SEQ ID NO: 169431 - protein, 203 aa, Heterodera glycines
  Homolog annotation: Hit_ID=NP_788728.1; Match level="QueryCoverage =69%, HitCoverage=50%, E-value=7e-14, Identity=36%"; Hit description =CG33108-PA [Drosophila melanogaster] gb|AAF56219.2| CG33108-PA [Drosophila melanogaster]
  Coding regions on vcDNA: vcDNA=SeqID_95854; Strand=+; Position=15-623
MFAGIDGQQNLLLSAQLQRLLCHHGETANAFVFCHQMQPELQKGPTCGFAVLLMALRCSVGDGTLDRLVEMGKHFGITYNGELFSADWMCEFVQKHWPNACELRVAQFPSPNSIVRHLISGKKAHHQCTTTVLVPYDCDKNFEPCNRQGVAAHWAIIIGFVIFDVTAQNGPENQNAKVIAFDENDFRCDGFDNEHLLYLIALQ

SEQ ID NO: 169432 - protein, 152 aa, Heterodera glycines
  Coding regions on vcDNA: vcDNA=SeqID_95855; Strand=+; Position=42-497
MFELADQSDGTSGIKQLWALIDPIWKFDRAELVDCMAKRVIYETDDLIALDKPFQMAFSSGPDDQPQLDRILQDLKKHIAPKIDRLFLVSSLDKNCSGVIVFAKSHVKQLEMKAQLQNDALLFRYRAICKGVPKLAKARISIPLIKVLRGSN

SEQ ID NO: 169433 - protein, 91 aa, Heterodera glycines
  Coding regions on vcDNA: vcDNA=SeqID_95856; Strand=+; Position=36-311
FAMNKKFINALFHQQMFKNAVLLPFRHFAALTATQTHIDPVPLSFLRQSEDESEQKTTIMPKWKEEGLKIERNCSNRIFQTIAKDVKLLTN

SEQ ID NO: 169434 - protein, 68 aa, Heterodera glycines
  Coding regions on vcDNA: vcDNA=SeqID_95857; Strand=+; Position=85-288
RFDFFERPKMNHMAKIFIQNWHFKFFLIPHFLLYFSSFCNIFSSAFPILAFLYKLIVSPSQKRKILLL

SEQ ID NO: 169435 - protein, 58 aa, Heterodera glycines
  Homolog annotation: Hit_ID=CAA07704.1; Match level="QueryCoverage =68%, HitCoverage=33%, E-value=2e-16, Identity=100%"; Hit description= lacZ' [Cloning vector pGreen]
  Coding regions on vcDNA: vcDNA=SeqID_95858; Strand=+; Position=316-489
PIYRKSDLHTRSKVVAVCSRGGPVPNSPYSESYYNSLAVVLQRRDWENPGVTQLNRLA

SEQ ID NO: 169436 - protein, 161 aa, Heterodera glycines
  Homolog annotation: Hit_ID=S42136; Match level="QueryCoverage=77%, HitCoverage=8%, E-value=4e-10, Identity=32%"; Hit description=cnjB protein - Tetrahymena thermophila gb|AAC37171.1| cnjB [Tetrahymena thermophila] prf||1922371A cnjB gene
  Coding regions on vcDNA: vcDNA=SeqID_95859; Strand=+; Position=12-494
MTSNSTDGWGCNNSGWGQSQAKMTSNSAADGWGCNNSALRPNQAKMTSNSAADGWGCNNSALRPNQAKMTSNSAADGWGCNNSALRPNQAKMTSNSTDGWGCNNNGWAPSQAKMTNSTDGSGCNNSVRGPREFSRSFSGRPGFNRQPVPLMNKLPPIPPST

SEQ ID NO: 169437 - protein, 201 aa, Heterodera glycines
  Homolog annotation: Hit_ID=NP_083307.1; Match level="QueryCoverage =59%, HitCoverage=28%, E-value=2e-11, Identity=33%"; Hit description =carbohydrate kinase-like [Mus musculus] emb|CAI24581.1| carbohydrate kinase-like [Mus musculus] emb|CAI24
  Gene Ontology: Biological process=carbohydrate metabolism
  Coding regions on vcDNA: vcDNA=SeqID_95860; Strand=+; Position=26-628
MPLFLGIDLGTTSVKIALIDGDKKTFLEWDRKHNALIEREEKDKHEQSPKKILDTVQKLMGEMETDKLAQVKGIGISGQMHGVMLWEADSIGLGVDRCHCSPLITWMDSRCDEQFLRKLPNIPLDSVQKCVYFLTKCRVVGFRLRLHLDRPTDKLIDALPLFPISFCFSSRPFPHSFAALHRFPRHFHWPHFASLRPFAKR

SEQ ID NO: 169438 - protein, 39 aa, Heterodera glycines
  Coding regions on vcDNA: vcDNA=SeqID_95861; Strand=-; Position=1-117
PGLVPRGAPRVGPGCPFGPGTVLYTTPFCPGCPGCPDPP

SEQ ID NO: 169439 - protein, 235 aa, Heterodera glycines
  misc_feature (155)..(155): Xaa can be any naturally occurring amino acid
  Homolog annotation: Hit_ID=NP_569117.1; Match level="QueryCoverage =92%, HitCoverage=54%, E-value=3e-70, Identity=58%"; Hit description =acetyl-Coenzyme A acyltransferase 2 (mitochondrial 3-oxoacyl -Coenzyme A thiolase) [Rattus norvegicus] emb
  Gene Ontology: Mol. function=3-oxoacyl-[acyl-carrier protein] reductase activity; Cellular component=mitochondrion; Biological process=ergosterol biosynthesis
  Coding regions on vcDNA: vcDNA=SeqID_95862; Strand=+; Position=51-759
MATKAGIFIVSAKRCAFGAFGGSLKNHTATDLGEIAAAAALKSSSIAAEHIDHVIFGNVIQSSKDAAYLARHIGLRVGVPVHVPAVTVNRLCGSGFEAIAQGGQQILAGDSKVVLAGGTESMSQAPFAVRGARFGTQLGAKIEFEDVLWQGLTDXHANMPMGITAENLGAKYNVTREEADAYAIRSQNRWRLANNAGYFKSEIVPVKLQGNARGKTVQGTNPRESTADKWQLKPF

SEQ ID NO: 169440 - protein, 62 aa, Heterodera glycines; identical to SEQ ID NO: 166156
  Homolog annotation: Hit_ID=EAK88176.1; Match level="QueryCoverage =62%, HitCoverage=1%, E-value=5e-09, Identity=66%"; Hit description =signal peptide containing large protein with proline stretches [Cryptosporidium parvum]
  Coding regions on vcDNA: vcDNA=SeqID_95863; Strand=+; Position=7-195

SEQ ID NO: 169441 - protein, 41 aa, Heterodera glycines
  Coding regions on vcDNA: vcDNA=SeqID_95864; Strand=+; Position=46-171
PSKTKQSIGPHNISTHNNIYLLSKILHVTLSQRKESKVAKL

SEQ ID NO: 169442 - protein, 68 aa, Heterodera glycines
  Homolog annotation: Hit_ID=AAR30497.1; Match level="QueryCoverage =100%, HitCoverage=5%, E-value=1e-19, Identity=60%"; Hit description =RhoGEF [Caenorhabditis elegans]
  Coding regions on vcDNA: vcDNA=SeqID_95865; Strand=+; Position=274-477
MDWGSDLEVDTEIPSLESLVSWEILKHLKPKEKKRQEVVNELYQTERTHVLRLKVLYKVFYRPMVLQR

SEQ ID NO: 169443 - protein, 132 aa, Heterodera glycines; identical to SEQ ID NO: 163202
  misc_feature (74)..(74): Xaa can be any naturally occurring amino acid
  Coding regions on vcDNA: vcDNA=SeqID_95866; Strand=+; Position=61-459

SEQ ID NO: 169444 - protein, 149 aa, Heterodera glycines
  Coding regions on vcDNA: vcDNA=SeqID_95867; Strand=+; Position=47-493
MASIVDSAKVNNFGIGTVVEPILVNKNGSTGGGGRRKNKTLFGISQAVHAEHPQQQLSEFAGGISPVDAVPMPTAANDCNNNSIEDIQSDRRRGPIDPTNFDHLVRLSELIRSMADLGTLQPEFGIICGSGLGAIADQMEGARILPFSE

SEQ ID NO: 169445 - protein, 48 aa, Heterodera glycines
  Coding regions on vcDNA: vcDNA=SeqID_95868; Strand=-; Position=2-148
VGNIVRTMCPLRNCSLCRSNAPNNASEERLNTPTMRPTRHSNSTNICW

SEQ ID NO: 169446 - protein, 162 aa, Heterodera glycines
  Coding regions on vcDNA: vcDNA=SeqID_95869; Strand=+; Position=17-505
RKQRFLFFSRFKMSLFLLRALPLFFLFSLCFAASPFNFRANHSLGAETTQQIVPTVATETTDGPKPTENVPLMLENDNVTEVAKVEGRNASDSEIETREDQAFANITAHSSDNASLTESCGFFCRNVPLFVGFILTLVCVSLLLILSIVLYRYFTRRTYADE

SEQ ID NO: 169447 - protein, 111 aa, Heterodera glycines
  misc_feature (70)..(70): Xaa can be any naturally occurring amino acid
  misc_feature (87)..(87): Xaa can be any naturally occurring amino acid
  Homolog annotation: Hit_ID=AAT02521.1; Match level="QueryCoverage =89%, HitCoverage=8%, E-value=9e-14, Identity=41%"; Hit description =cell wall protein GP2 [Chlamydomonas reinhardtii]
  Coding regions on vcDNA: vcDNA=SeqID_95870; Strand=-; Position=46-381
MAICSRVLPLDVSLAFTSAPPAKAPKRLPMSPPLTALNSVDRMSPPPAPPPKAPLPPPPPPRNPPINSPXPYLPTDCHCLRRPAAAXSPEFAPPPPPPPRSPLISWSIIEI

SEQ ID NO: 169448 - protein, 138 aa, Heterodera glycines
  Coding regions on vcDNA: vcDNA=SeqID_95871; Strand=+; Position=65-481
MGNCKPADATESENASSVETVEVEVPPDPLVNPFWKMQKAFEKKLRNLLKREKKLLQLKEERDSDKPITTDQHEALSKLDEVKTLIGFVDEMMKLNQQQFSQYKKAIKNRERQLKMQKARSQTGQQFPSRQSYVHCFN

SEQ ID NO: 169449 - protein, 172 aa, Heterodera glycines
  Homolog annotation: Hit_ID=CAG01465.1; Match level="QueryCoverage =96%, HitCoverage=94%, E-value=1e-61, Identity=63%"; Hit description =unnamed protein product [Tetraodon nigroviridis]
  Gene Ontology: Mol. function=N-acetyltransferase activity; Cellular component=nucleus; Biological process=protein modification
  Coding regions on vcDNA: vcDNA=SeqID_95872; Strand=+; Position=3-521
FEPFDLFRFGAVNLDPLTETYGLPFYLHYLVNWPDYFMVAEHLSGDLMGYIMGKSEGRDQNWHGHVTAVSVAPEYRRMGLAARFMQKLELVSEKEDCFFVDLFVRISNETAINMYKRLGYTVYRQIVDYYSGDDTHEDEDAFDMRKALPRDVDKKSVVPLKHPVSCNEIDFD

SEQ ID NO: 169450 - protein, 46 aa, Heterodera glycines; identical to SEQ ID NO: 166147
  Coding regions on vcDNA: vcDNA=SeqID_95873; Strand=+; Position=1-141

SEQ ID NO: 169451 - protein, 104 aa, Heterodera glycines; identical to SEQ ID NO: 162389
  Homolog annotation: Hit_ID=XP_310658.1; Match level="QueryCoverage =89%, HitCoverage=69%, E-value=6e-30, Identity=67%"; Hit description =ENSANGP00000020734 [Anopheles gambiae]
  Gene Ontology: Biological process=sporulation (sensu Saccharomyces)
  Coding regions on vcDNA: vcDNA=SeqID_95874; Strand=+; Position=11-325

SEQ ID NO: 169452 - protein, 92 aa, Heterodera glycines; identical to SEQ ID NO: 164021
  Coding regions on vcDNA: vcDNA=SeqID_95875; Strand=-; Position=51-329

SEQ ID NO: 169453 - protein, 205 aa, Heterodera glycines
  Homolog annotation: Hit_ID=CAE69260.1; Match level="QueryCoverage =72%, HitCoverage=21%, E-value=3e-27, Identity=39%"; Hit description =Hypothetical protein CBG15311 [Caenorhabditis briggsae]
  Coding regions on vcDNA: vcDNA=SeqID_95876; Strand=+; Position=76-690
MANPNSDHSLPLSPSPSPSHSSHSFSLRSVFAHHFCFFCSNSVLIALVVFTLSLLMAFLLGKRRSSQNALAKRRRDKSPEGIELEENPEVFKSSLLKDSKEHIISTYFPDVRTLFDAFQRGLKVAEHSACLGFRPAKGSPYQFLTYAEVAVRSQSFGHALISKLGLQPGNETFVAIYAQNCPEWMITAIGCTRHSMVIVPLYDTL

SEQ ID NO: 169454 - protein, 111 aa, Heterodera glycines
  Homolog annotation: Hit_ID=NP_778174.1; Match level="QueryCoverage =83%, HitCoverage=92%, E-value=4e-12, Identity=34%"; Hit description =e(y)2 protein [Mus musculus] ref|NP_064574.1| e(y)2 protein [Homo sapiens] gb|AAH48361.1| E(y)2 protein [
  Coding regions on vcDNA: vcDNA=SeqID_95877; Strand=+; Position=14-349
MQGSSARSFLNFKKKLQRKEDLEKEFVESGEKDRVQEVVERRLHESGWAKRVESMCEEYIAKKGYERVELQAMVDELKDASRRIVPDEVKRELMQLIQEFVNSRTSTGEGW

SEQ ID NO: 169455 - protein, 149 aa, Heterodera glycines
  Homolog annotation: Hit_ID=NP_500306.1; Match level="QueryCoverage =82%, HitCoverage=19%, E-value=3e-45, Identity=71%"; Hit description =acetolactate synthase homolog (69.3 kD) (4E27) [Caenorhabditis elegans] gb|AAC17553.2| Hypothetical prote
  Gene Ontology: Biological process=embryogenesis and morphogenesis
  Coding regions on vcDNA: vcDNA=SeqID_95878; Strand=+; Position=3-449
IVSLCLLISVKILRLTNLDILFRIRDGLRSGKPFITALFRVDIESQRHGGELVAEVLKAHGVRELFTLCGGHISPILVACEQIGIRVLDTRHEATAVFAADAAARLRQDIGVAAVTAGPGITNTVTALKNAQMAESPVLLLGGASPSLL

SEQ ID NO: 169456 - protein, 176 aa, Heterodera glycines
  Homolog annotation: Hit_ID=CAE68033.1; Match level="QueryCoverage =84%, HitCoverage=49%, E-value=1e-37, Identity=52%"; Hit description =Hypothetical protein CBG13650 [Caenorhabditis briggsae]
  Coding regions on vcDNA: vcDNA=SeqID_95879; Strand=+; Position=86-613
MECPPGSSFDPSPSPSVASQPFSEECHSPDNQISLDNSVPEESPNGNANVCMGEAKPRWGPTHAGAKQLASMYGKGKRLQEVTCICVASALFLSVGCSLLYHFRLVPVGQLILASLVGVLMADFNSGVVHWGADTWGTVDTFVGRNYNRSFREHHVDSTAITRHDLVEVNGDNFML

SEQ ID NO: 169457 - protein, 207 aa, Heterodera glycines
  Homolog annotation: Hit_ID=NP_006702.1; Match level="QueryCoverage =93%, HitCoverage=64%, E-value=6e-18, Identity=36%"; Hit description =RNA-binding protein S1, serine-rich domain [Homo sapiens] ref|NP _542161.1| RNA-binding protein S1, serine
  Gene Ontology: Mol. function=RNA binding; Cellular component=nucleus; Biological process=RNA splicing
  Coding regions on vcDNA: vcDNA=SeqID_95880; Strand=+; Position=28-648
MANDSRSSSSASSRSRSRSRSRSPRRREQRRRRSRSTFSRSPSPGQKRLHIGNLDESVRRRDIEDVFGKYGRISDCWMASYPPFYAFVVFENNKDASACMKDLGNTAYIKGCRARVTVALPRKGSSLDANSMNGATYRRGPPPPPRRYYDEEDSHRRRRRSRTRSPRRRRSPSRSRSRTPPRRSRSPRRSARRQRSPSPKREPRNRG

SEQ ID NO: 169458 - protein, 150 aa, Heterodera glycines
  Homolog annotation: Hit_ID=AAF76925.1; Match level="QueryCoverage =100%, HitCoverage=100%, E-value=3e-85, Identity=99%"; Hit description=hypothetical esophageal gland cell secretory protein 11 [Heterodera glycines]
  Coding regions on vcDNA: vcDNA=SeqID_95881; Strand=+; Position=96-548
MFRFSLLLLLVPLVRCVPNPKPLFGIGIGRKQSAGAEGKLTCAGEPLADVKVKLYDDDRGVDTDDLMGETRTDSEGRFRLEGYTHEITTIDPKINIYHDCNDGLKPCQRKISIMIPDKYIASGEHPNTYYDAGTIELEGKFSGETRDCLH

SEQ ID NO: 169459 - protein, 134 aa, Heterodera glycines
  Homolog annotation: Hit_ID=NP_497829.1; Match level="QueryCoverage =100%, HitCoverage=52%, E-value=9e-41, Identity=56%"; Hit description= protein likely ortholog of mouse Ly1 antibody reactive clone (28.5 kD) (3F252) [Caenorhabditis elegans]
  Coding regions on vcDNA: vcDNA=SeqID_95882; Strand=+; Position=73-474
MVFFICDQCGETMKKKQVLQHIHRCRNAHYSCMDCQVVFDKNSYQGHTKCITEDQKYGGARHVPKVNKGEQKQDAWVSQVRAAIRQVDEPRLKNLLRSVQCHTNIPRKEAKFVNFLQNSLRIRDRALCVDAWNA

SEQ ID NO: 169460 - protein, 181 aa, Heterodera glycines
  Homolog annotation: Hit_ID=CAE56800.1; Match level="QueryCoverage =98%, HitCoverage=51%, E-value=4e-67, Identity=67%"; Hit description =Hypothetical protein CBG24612 [Caenorhabditis briggsae]
  Gene Ontology: Cellular component=membrane; Biological process =intracellular protein transport
  Coding regions on vcDNA: vcDNA=SeqID_95883; Strand=+; Position=1-590
RFSSSNVGCFSAVKMTAAAKLSRFFRRLVHVRQMDFEFAAWQMLYLLVNPQKVYRNFMYRKKAKDQWARDDPAFLLLLALSLLGSSVLFALALNLSFSSFCAFFLWVVFIDCIGIGIAIATALWFISNRFLRRTRDCDVVEWAYCFDVHLNAFFPLLILLHVILPLLFYGLVDYQNFLARF

SEQ ID NO: 169461 - protein, 145 aa, Heterodera glycines
  Homolog annotation: Hit_ID=NP_495686.2; Match level="QueryCoverage =65%, HitCoverage=7%, E-value=6e-34, Identity=67%"; Hit description =ubiquitin thiolesterase, family 2 (150.2 kD) (2I337) [Caenorhabditis elegans] emb|CAA87795.2| Hypothetical
  Gene Ontology: Mol. function=ubiquitin-specific protease activity; Cellular component=nucleus; Biological process=pathogenesis
  Coding regions on vcDNA: vcDNA=SeqID_95884; Strand=+; Position=37-471
MKKLTVHPDIMDIVRELDDKCLRSIEDSYFDRMGQGPTYHTDENAQRPELLDENGHRYVGLFNQAMTCYLNSLIQTLYMTPEFRNKVYSWKFVDTPTNEDNKNIPYQLQRLFLLLQTSEKASLETKELTTSFGWVSNEAFEQHDV

SEQ ID NO: 169462 - protein, 149 aa, Heterodera glycines; identical to SEQ ID NO: 163186
  Homolog annotation: Hit_ID=CAE71256.1; Match level="QueryCoverage =91%, HitCoverage=59%, E-value=3e-25, Identity=46%"; Hit description =Hypothetical protein CBG18136 [Caenorhabditis briggsae]
  Coding regions on vcDNA: vcDNA=SeqID_95885; Strand=+; Position=21-470

SEQ ID NO: 169463 - protein, 262 aa, Heterodera glycines
  Homolog annotation: Hit_ID=CAE68613.1; Match level="QueryCoverage =90%, HitCoverage=40%, E-value=8e-68, Identity=54%"; Hit description =Hypothetical protein CBG14494 [Caenorhabditis briggsae] emb|CAE68611.1| Hypothetical protein CBG14492 [Cae
  Gene Ontology: Mol. function=ammonium transporter activity; Cellular component=plasma membrane; Biological process=ammonium transport
  Coding regions on vcDNA: vcDNA=SeqID_95886; Strand=+; Position=44-829
MVTQNDHLMANLSDQLTNLQKELDTLKKDMTANNDAFFNCAMALIIFLMQCGFAFLEAGAVRSKNCTNIIIKNVLDSLLGIIAYAAVGWALAFGSNPLPVLEPYFGFSQFGMVGTTEFSKFFFQFVFCATASTIISGAVAERAEFACFITYSLAITAFVYPVLTHWGWTKQGWMAASGFVVDDAHQITYVDFAGSGMVHVCGGTISLIAAALMGPPIGRFPERTVSVPVGGPRRKQNEPKSVEIKRHSVPLASMWGFILIAG

SEQ ID NO: 169464 - protein, 111 aa, Heterodera glycines; identical to SEQ ID NO: 163844
  Homolog annotation: Hit_ID=AAP06016.1; Match level="QueryCoverage =83%, HitCoverage=91%, E-value=3e-30, Identity=63%"; Hit description =similar to GenBank Accession Number AJ238010 heat shock protein 10 in Oryzias latipes [Schistosoma japonic
  Gene Ontology: Mol. function=ATP binding; Cellular component =mitochondrion; Biological process=protein folding
  Coding regions on vcDNA: vcDNA=SeqID_95887; Strand=+; Position=33-368

SEQ ID NO: 169465 - protein, 158 aa, Heterodera glycines
  Homolog annotation: Hit_ID=XP_419409.1; Match level="QueryCoverage =98%, HitCoverage=10%, E-value=1e-59, Identity=61%"; Hit description =PREDICTED: similar to Eprs protein [Gallus gallus]
  Gene Ontology: Mol. function=proline-tRNA ligase activity; Cellular component=cytoplasm; Biological process=protein complex assembly
  Coding regions on vcDNA: vcDNA=SeqID_95888; Strand=+; Position=96-569
MGKEQQKQQNKEKKVAAQQQQNTGDEAGTKKQTRLGLDVTKTENYSEWYSQVIVKAELIEYYDVSGCYVIRPWAYSVWEHIQAFFDAEIKKLGVKNCYFPMFVSAAALEREKTHVADFAPEVAWVTKAGNNDLAVPIAIRPTSETVMYPTFAKWCKSH

SEQ ID NO: 169466 - protein, 142 aa, Heterodera glycines
  Homolog annotation: Hit_ID=EAA49094.1; Match level="QueryCoverage =88%, HitCoverage=70%, E-value=2e-09, Identity=33%"; Hit description =hypothetical protein MG00752.4 [Magnaporthe grisea 70-15] ref|XP _368492.1| hypothetical protein MG00752.4
  Coding regions on vcDNA: vcDNA=SeqID_95889; Strand=+; Position=47-472
MAAATTTMPSFYFHKHFFQRIFPGKPFFVQVFSAGVLAATGDILCQKFIEKRDKWDPFRTSRFALTTAIVIAPIQFHWFRFMDRRIGNPKREGPAGKVTLQTGLKRVLVDQSLIAPALTAAFLFSVNFLDSFSTQNAIQRTK

SEQ ID NO: 169467 - protein, 69 aa, Heterodera glycines
  Coding regions on vcDNA: vcDNA=SeqID_95890; Strand=-; Position=2-208
VKGRLTTITKKQQQHFAPPFPRSAEFSLRPSAHFFACLRLRFSRRIRFLRHFARIFQCQKELKRKRGSS

SEQ ID NO: 169468 - protein, 73 aa, Heterodera glycines
  misc_feature (4)..(4): Xaa can be any naturally occurring amino acid
  misc_feature (6)..(7): Xaa can be any naturally occurring amino acid
  misc_feature (21)..(21): Xaa can be any naturally occurring amino acid
  Coding regions on vcDNA: vcDNA=SeqID_95891; Strand=-; Position=7-228
LRRXSXXAEKGNRLSTKTRLXSGRTRFPCSYLPLLLPPPAGGTHSVTSGSTPRWRRCSINSSNALSTSSQHVI

SEQ ID NO: 169469 - protein, 144 aa, Heterodera glycines
  Homolog annotation: Hit_ID=CAE74105.1; Match level="QueryCoverage =55%, HitCoverage=74%, E-value=8e-10, Identity=38%"; Hit description =Hypothetical protein CBG21765 [Caenorhabditis briggsae]
  Coding regions on vcDNA: vcDNA=SeqID_95892; Strand=+; Position=3-437
SSVRQTELSLERHEWQTVMCSNGVIACWHPPKQFPFEHSRTFNMEKAMSEKEKFLNRKPDQTLFTTAPDDNALCEIFHTEKQEWRPIYREKRLYNAKVEDQLKPILSNPLETPTAPVITKNVENEAHRIEQGVNEGNNPNILSE

SEQ ID NO: 169470 - protein, 198 aa, Heterodera glycines
  Homolog annotation: Hit_ID=NP_505666.1; Match level="QueryCoverage =87%, HitCoverage=72%, E-value=3e-27, Identity=35%"; Hit description =udp-glucuronosyltransferase family member (5K853) [Caenorhabditis elegans] emb|CAA94866.1| Hypothetical p
  Coding regions on vcDNA: vcDNA=SeqID_95893; Strand=+; Position=112-705
DFGGKSLFKVLADSAFEKPSLVDIFFSSKLFQASLNDACEALIRTQSQQFKLLKKRNFDVIISEQLNFCGAGIGHLLDISVNIVLSSCSLQEHLASLIGLPFPSSFVPSLMDSNWSDKMSLLQRFQNLLHKFAGYNYLSFGIDPLTQIFRKHFGNAFPDLRSIVSKSPLIFVASDEFVDFPRPLFSNVIYIGGLGMEK

SEQ ID NO: 169471 - protein, 81 aa, Heterodera glycines
  Homolog annotation: Hit_ID=NP_501616.1; Match level="QueryCoverage =81%, HitCoverage=94%, E-value=2e-10, Identity=42%"; Hit description =putative protein (8.1 kD) (4K24) [Caenorhabditis elegans] emb|CAB63344.1| Hypothetical protein Y11D7A.10
  Coding regions on vcDNA: vcDNA=SeqID_95894; Strand=+; Position=2-247
KVIWIPKRIWGESLAFAGILIGLHFVYYSMQNNPNLIPLNDRRELIYVKWIKEKFPSLGWVGIDDSEAMKRRERIMGQKEQ

SEQ ID NO: 169472 - protein, 72 aa, Heterodera glycines
  Coding regions on vcDNA: vcDNA=SeqID_95895; Strand=-; Position=1-216
NDQNKTMLNKEKMAKYNDKQIKIELTVTAQPKPNENRKSSKVEIEKSAFRHFLAELVRLAQESIEIEITLTV

SEQ ID NO: 169473 - protein, 93 aa, Heterodera glycines
  Coding regions on vcDNA: vcDNA=SeqID_95896; Strand=+; Position=1-279
NHRPTFAIGISAKSQENAFFALRKKRKKSGKKKRKRTKNEWKRENEKTGGAAKQKAKLPENVNNVSNMYTDNSNLEHIEHLLLILNIKYTKKP

SEQ ID NO: 169474 - protein, 159 aa, Heterodera glycines
  Coding regions on vcDNA: vcDNA=SeqID_95897; Strand=-; Position=2-478
FCFFVYLILRINNRCSMCSKLELSVYIFDTLNIFWKFCFLFRGSPRLLILSLPLILCPLPLLLPLLSQCKKRIFLALCRNPNCKSRAIVPLPVGVLHSKTDRTLHWRTFLADPRFWPFLLRDGHLEECRCFAQSIAVVFWGENAAFRNTNHCAKLLTES

SEQ ID NO: 169475 - protein, 126 aa, Heterodera glycines
  Homolog annotation: Hit_ID=CAE73097.1; Match level="QueryCoverage =96%, HitCoverage=15%, E-value=1e-39, Identity=62%"; Hit description =Hypothetical protein CBG20476 [Caenorhabditis briggsae]
  Gene Ontology: Mol. function=protein tyrosine kinase activity; Cellular component=chromosome; Biological process=signal transduction
  Coding regions on vcDNA: vcDNA=SeqID_95898; Strand=+; Position=2-382
EVYTGKIMFPGKSNNQMLKFMMDLRGKFPNKVIRKAVFKDQHFDYNCNFLYHETDKVTGKDKVTVLTNIKLLRNLPAELSGDQELDRDGFAKVDHFRSLLEQMTALDPSKRISCSDALKHPFIVEK

SEQ ID NO: 169476 - protein, 183 aa, Heterodera glycines; identical to SEQ ID NO: 164004
  Homolog annotation: Hit_ID=CAE72800.1; Match level="QueryCoverage =94%, HitCoverage=96%, E-value=3e-19, Identity=34%"; Hit description =Hypothetical protein CBG20077 [Caenorhabditis briggsae]
  Coding regions on vcDNA: vcDNA=SeqID_95899; Strand=+; Position=4-555

SEQ ID NO: 169477 - protein, 152 aa, Heterodera glycines
  Coding regions on vcDNA: vcDNA=SeqID_95900; Strand=+; Position=33-488
MSDFFLDNSDMDDNELELKLNNLQMLKNRRANKSLKMPPTDIGTTKLPVNGKGIGYRPLPENAQLKRDIETKMGTTDSEEKEKEPKEENRVPPNENGNGNRPLSDNAKEKNAQLKREIKEILGIIDSEEKETEPKETKFCEMFSWVQLFFGL

SEQ ID NO: 169478 - protein, 208 aa, Heterodera glycines
  Homolog annotation: Hit_ID=CAE56708.1; Match level="QueryCoverage =67%, HitCoverage=10%, E-value=4e-11, Identity=35%"; Hit description =Hypothetical protein CBG24494 [Caenorhabditis briggsae]
  Coding regions on vcDNA: vcDNA=SeqID_95901; Strand=+; Position=84-710
MPIQLCEHGRVMPGPFIRGEIKAVNTSAARRLIREFNVNTTLYTGANICVNCCSRLRDHQETRRRGRTEAILYYPEGATLFIKLNGDENDGNTTKGKKTTTGPSAAVTRRAASKGLIKIRICSDETINALKLRIYEKIDQSPVDQLLYMGGQVLDGNLTLERARVPANNFDNPLILIVQQRRKSGDDDDSDQKAGSSGGGGFHDTALS

SEQ ID NO: 169479 - protein, 149 aa, Heterodera glycines
  Coding regions on vcDNA: vcDNA=SeqID_95902; Strand=+; Position=28-474
MLESAVLFLLNLFYAFANFCLDLLPNSSPMGSKSTPATADVAYANYRLFDELNRKVRESLRKAIEADETRIAKSRVIGLYENVLKQINKALEIRHTSCPSHKQTEMQEQQKKLKAFVGQTKDRLEKLASIEPMALRATPLPLATVETGN

SEQ ID NO: 169480 - protein, 67 aa, Heterodera glycines
  Coding regions on vcDNA: vcDNA=SeqID_95903; Strand=-; Position=0-200
KFLHGLCCWSPKYSTVPRCTAKHMTKLPGTERPQMLRPKSIWTSPLGCSRACSHFDDPSRGPTVNSV

SEQ ID NO: 169481 - protein, 83 aa, Heterodera glycines
  Coding regions on vcDNA: vcDNA=SeqID_95904; Strand=+; Position=306-554
PRRKERRRPRPSPDVFRAREKFITSNPDLIESLRKQKFDVVIEEQLNFCGAGLGHLLAIPIHILINSCPLQEHVAYLFGLPFP

SEQ ID NO: 169482 - protein, 154 aa, Heterodera glycines
  Homolog annotation: Hit_ID=NP_504477.1; Match level="QueryCoverage =72%, HitCoverage=41%, E-value=5e-16, Identity=41%"; Hit description =predicted CDS, cyclin G1 interacting protein like (5G74) [Caenorhabditis elegans] pir||T32530 hypothetica
  Coding regions on vcDNA: vcDNA=SeqID_95905; Strand=+; Position=12-473
MATQSNFGKFQQRSSRQSSRIISQQPTKCFDEAAKRRRIQQQLESLEKDNFQEDPHANITWHKAAPKFDDEMVFGDKEKKRRKRKIASPSKVSGAEQATKKGKKIVAALTKTRFRKTFAQLLEEAQRKREEETQQRRKEASPELLLPTYYEVAS

SEQ ID NO: 169483 - protein, 199 aa, Heterodera glycines
  Coding regions on vcDNA: vcDNA=SeqID_95906; Strand=+; Position=3-599
CYIFCFRIWVATASTASYRTAGPKTKVPDKNEWMKRCAAEYERKYCVETDTKLKQQTTKNKEKKQQQQQDESPEEYYPTNYEPAFNYDKLHVSDITLPLTIHQKDQYQAQNGPTKYEPKAEGQHVTSSVTTAEAGKYSSSSGHASSSESEEEDRWEEPRKRSRNRERDERNGRHGEGEDKAAKRWYKSDESKEEKRDGK

SEQ ID NO: 169484 - protein, 53 aa, Heterodera glycines; identical to SEQ ID NO: 166121
  Coding regions on vcDNA: vcDNA=SeqID_95907; Strand=+; Position=1-162

SEQ ID NO: 169485 - protein, 225 aa, Heterodera glycines
  Homolog annotation: Hit_ID=XP_521029.1; Match level="QueryCoverage =98%, HitCoverage=71%, E-value=5e-24, Identity=30%"; Hit description =PREDICTED: similar to XRP2 protein [Pan troglodytes]
  Gene Ontology: Mol. function=chaperone activity; Cellular component =microtubule; Biological process=beta-tubulin folding
  Coding regions on vcDNA: vcDNA=SeqID_95908; Strand=+; Position=2-676
FTFSQKPEKRPKKDDRNENNDTFEHNTQSNSFVGAAISALQLSAKDVDTTFQGIVEQTVFRGSADGNPFAIRECTGSLLVLLGHAATITIDKCSNCVIICGPCRGSIFMRNCANCLLLAACHQFRLQNSRDIEAHLHCSTNPTIEDSDLIVAPLLMRYDGFKEDMESARLDNAPNLWDKVQNFTAETGQFQRMNFDPFANGAISSEVVSDELLEKLSTVMEEPEA

SEQ ID NO: 169486 - protein, 207 aa, Heterodera glycines
  Homolog annotation: Hit_ID=CAE70749.1; Match level="QueryCoverage =100%, HitCoverage=28%, E-value=7e-75, Identity=68%"; Hit description= Hypothetical protein CBG17495 [Caenorhabditis briggsae]
  Coding regions on vcDNA: vcDNA=SeqID_95909; Strand=+; Position=2-622
ENKDGSFLNKRDISDPYCEIQVGSQVFHTRVINNNLNPVFNECFEAVVDQASGQKLRIELFDKDTAGADEELGRLSIPLESVRQAGEMERWHHLEGCKHGELRLKVCWMDLSTESTGVGRDEWEQEWLGADKPMHPALLMVFIDSVANLPYPKSNLEPSPFVEVSLGRITQRTPVKPKTVNPLFQSKFNFFVKQPEGQELKIRAVDE

SEQ ID NO: 169487 - protein, 307 aa, Heterodera glycines
  misc_feature (131)..(131): Xaa can be any naturally occurring amino acid
  Homolog annotation: Hit_ID=CAE72865.1; Match level="QueryCoverage =99%, HitCoverage=80%, E-value=4e-91, Identity=56%"; Hit description =Hypothetical protein CBG20164 [Caenorhabditis briggsae]
  Gene Ontology: Mol. function=Hsp70/Hsc70 protein regulator activity; Cellular component=cytosol; Biological process=protein-mitochondrial targeting
  Coding regions on vcDNA: vcDNA=SeqID_95910; Strand=+; Position=36-955
MKSNSKTADIGDFYEILGVPRNASEQEIKNAYRKLALTYHPDRNPGNEQAQEQFKKVSIAYSVLSDPNKRRQYDVSGPSMAMNDFEGLDISELGGVGRFFGAMFTKLGIPIPTQIGPKVLAQARDLSRGNXHKRPLEPGLVLSETVNNQEANFYAFQMTPEFQQHGVIIRCKSLAMSKFKLVLFDQEGAVRHIRESQKKKKYTSAELFFVPFQRINISEFIPIRFYMEDKDTPLPFHFLDTLETHGANVMELQPGKHILCVYGDNFLRMVSYEITFLPLNHYASAAINKINALEPVLASKKSEMQEF

SEQ ID NO: 169488 - protein, 83 aa, Heterodera glycines
  Homolog annotation: Hit_ID=CAE65930.1; Match level="QueryCoverage =98%, HitCoverage=97%, E-value=5e-36, Identity=81%"; Hit description =Hypothetical protein CBG11103 [Caenorhabditis briggsae]
  Gene Ontology: Biological process=cell growth
  Coding regions on vcDNA: vcDNA=SeqID_95911; Strand=+; Position=16-267
MAKRKSKRKAPTKAKSIVALETQFNCPFCNHENVCEVKMDRERNVGFIQCRVCMEDFQSNITALSEPIDVYSDWIDACEAANQ

SEQ ID NO: 169489 - protein, 103 aa, Heterodera glycines
  Coding regions on vcDNA: vcDNA=SeqID_95912; Strand=+; Position=2-313
KLELPAVAAAFELVDPPGCFTQNEDYDPDIWHSKEQQRQLMHNAKQSRILKELGCPAMGDGCCSIALLEASVKARVRDVARYQLRRALASNKLFKSRGRNDQQ

SEQ ID NO: 169490 - protein, 89 aa, Heterodera glycines
  Coding regions on vcDNA: vcDNA=SeqID_95913; Strand=+; Position=18-287
FLAMGKDTKGDYDPDICHSKEQQRQLMHNAKQSRILKELGCPAVGGGCCSDALLEASVKARVRDVARYQLRRALASNLLFKSRGRNDQL

SEQ ID NO: 169491 - protein, 99 aa, Heterodera glycines; identical to SEQ ID NO: 163168
  Coding regions on vcDNA: vcDNA=SeqID_95914; Strand=+; Position=39-338

SEQ ID NO: 169492 - protein, 99 aa, Heterodera glycines
  Homolog annotation: Hit_ID=CAA07704.1; Match level="QueryCoverage =62%, HitCoverage=51%, E-value=1e-30, Identity=100%"; Hit description= lacZ' [Cloning vector pGreen]
  Coding regions on vcDNA: vcDNA=SeqID_95915; Strand=+; Position=246-542
MDESTNHQSREHSILIIIYINKSLIFKKKKKKKKKKNSRGGPVPNSPYSESYYNSLAVVLQRRDWENPGVTQLNRLAAHPPFASWRNSEEARTDRPSQQ

SEQ ID NO: 169493 - protein, 224 aa, Heterodera glycines; identical to SEQ ID NO: 162608
  Homolog annotation: Hit_ID=NP_386546.1; Match level="QueryCoverage =90%, HitCoverage=40%, E-value=9e-64, Identity=59%"; Hit description =PROBABLE MANNITOL 2-DEHYDROGENASE PROTEIN [Sinorhizobium meliloti 1021] emb|CAC47019.1| PROBABLE MANNITOL
  Coding regions on vcDNA: vcDNA=SeqID_95916; Strand=+; Position=35-706

SEQ ID NO: 169494 - protein, 217 aa, Heterodera glycines
  Homolog annotation: Hit_ID=NP_500379.1; Match level="QueryCoverage =84%, HitCoverage=35%, E-value=9e-29, Identity=39%"; Hit description =protein from EUROIMAGE 1967720 (62.7 kD) (4E360) [Caenorhabditis elegans] gb|AAD12825.1| Hypothetical pro
  Gene Ontology: Cellular component=mitochondrion
  Coding regions on vcDNA: vcDNA=SeqID_95917; Strand=+; Position=10-660
MVDAHFAGCAHIKSEYVVLRSETQQQEGGNKPPNESNPLEGNSHEGILPRNVRARGMDRQREQKMAKARAENRQKIVRICPSVLFESEGRKCKYGEKCDAEHSLTKYWAKKPPDIGPSCFLFDQMGKCSFSLSCCFARAHTNESDLSQKSKAGHSEWQSVLNTHTLPIQQQLRKRTYDFSRSERALHESPSGCMEREAPKWDMRTLRGKKYLAPPDD

SEQ ID NO: 169495 - protein, 87 aa, Heterodera glycines
  Coding regions on vcDNA: vcDNA=SeqID_95918; Strand=-; Position=4-267
IFSFFYIFILNKKKVHNNSKNPDQQAIPLQLGLHAFPSRKHQPRRHSSLRLGPGTFSPTSLYSPTKGRRRRTKRTDLLWINSNWKTI

SEQ ID NO: 169496 - protein, 300 aa, Heterodera glycines
  Homolog annotation: Hit_ID=NP_502196.1; Match level="QueryCoverage =100%, HitCoverage=33%, E-value=2e-67, Identity=47%"; Hit description= methionyl tRNA Synthetase (101.7 kD) (mrs-1) [Caenorhabditis elegans] emb|CAA97803.1| Hypothetical prote
  Gene Ontology: Mol. function=interleukin-8 receptor binding; Cellular component=cytoplasm; Biological process=apoptosis
  Coding regions on vcDNA: vcDNA=SeqID_95919; Strand=+; Position=3-902
LFTKIEPAKVAEWKELFGSGKQQQNQPKNNGPTAMSSSSSKKAPNSTEKQQQKQKKKKENMAEERGEVGQIYAEVMAKFEKAKALFVTNESEKLDTEIAALKEQITEQKARLGFTGALFSPPMPKATPAIVVPPAVSSPQTPPKLTAASNASKEQTQQKQQPKQKKPQQQQATAPADDTVDVGCLDLRVGRIIEAQKHPDADALYVEQIDLGEEKPRTVVSGLVRFVPLEQLKNRLVVCLCNLKPAKMRGVESQAMVMCASTPEKVEVLEVSPESVPGDLVVCEPFVRRPPQQLNPKKKI

SEQ ID NO: 169497 - protein, 171 aa, Heterodera glycines
  Coding regions on vcDNA: vcDNA=SeqID_95920; Strand=+; Position=78-590
GITNGLHCGDFIFLSDLDVSMNCVLLHAGVGESDLTLPMNLEPEFQISLLRVVGQPGLPTRARFKLPMHCVQHQQQMTIEFVPDGFNQTELEADNTWYLTLQFNRTGTKEQGTFLLANYTLDVRFFNVQNASSHYNGTYLYAKAPSFKPEWSATVQNGQPNIFTCSKNGLH

SEQ ID NO: 169498 - protein, 89 aa, Heterodera glycines
  Homolog annotation: Hit_ID=NP_501094.1; Match level="QueryCoverage =89%, HitCoverage=88%, E-value=2e-22, Identity=57%"; Hit description =transport to INner mitochondrial membrane (yeast TIM) TIN-9, TIMeless related (10.2 kD) (tin-9) [Caenorha
  Coding regions on vcDNA: vcDNA=SeqID_95921; Strand=+; Position=1-270
GATDTDLRTFRDFLFQYNAVTEQCFDACIRDFTSRDISEKEERCSKNCMDKFLKAGQRLSMRFQEHQLLNMEAQGAPVMATNTKVQIGK

SEQ ID NO: 169499 - protein, 236 aa, Heterodera glycines
  Homolog annotation: Hit_ID=NP_491515.2; Match level="QueryCoverage =99%, HitCoverage=67%, E-value=1e-117, Identity=87%"; Hit description= atpase (39.9 kD) (1F648) [Caenorhabditis elegans] gb|AAK85455.2| Vacuolar h atpase protein 16 [Caenorhab
  Gene Ontology: Mol. function=hydrogen-transporting ATPase activity, rotational mechanism; Cellular component=hydrogen-transporting ATPase V0 domain; Biological process=hydrogen transport
  Coding regions on vcDNA: vcDNA=SeqID_95922; Strand=+; Position=16-723
MGEFFFNLDHGYLEALIRGFKSGLLTSTDYSNLVQCETLEDLKLHIQSTDYGNFLANEPGNITVQVIDERLKEKLVTEFTHLRNNSLEPLATFLDYITYSYMIDNIILLITGTLHQRPINELISKCHPLGSFEQMEAIHIASNPAELYNAVLVDTPLAPYFVDCISEQDLDELNVEIIRNTLYKAYIEDFYNLCKKMGGKTAEVMCEILAFEADRRAFIITINSFDTELNKEDRAN

SEQ ID NO: 169500 - protein, 83 aa, Heterodera glycines; identical to SEQ ID NO: 166113
  Coding regions on vcDNA: vcDNA=SeqID_95923; Strand=+; Position=3-254

SEQ ID NO: 169501 - protein, 206 aa, Heterodera glycines; identical to SEQ ID NO: 162331
  Homolog annotation: Hit_ID=EAL47380.1; Match level="QueryCoverage =67%, HitCoverage=30%, E-value=2e-11, Identity=32%"; Hit description =PufA family RNA binding protein [Entamoeba histolytica HM-1:IMSS]
  Gene Ontology: Mol. function=RNA binding
  Coding regions on vcDNA: vcDNA=SeqID_95924; Strand=+; Position=12-629

SEQ ID NO: 169502 - protein, 119 aa, Heterodera glycines
  Coding regions on vcDNA: vcDNA=SeqID_95925; Strand=-; Position=1-357
FWRLFTSSRALEMLLSKSSKHRRKTRKLRTNFSGASGQEGSVQKKDMTGNSIRKVLIHADQLERLYSAEWPQIICQTLGHLAKIQTFTSVFYLFFEFKNNFKAQHGIWTNWKTLLINSG

SEQ ID NO: 169503 - protein, 112 aa, Heterodera glycines; identical to SEQ ID NO: 139313
  Coding regions on vcDNA: vcDNA=SeqID_95926; Strand=+; Position=169-504

SEQ ID NO: 169504 - protein, 87 aa, Heterodera glycines; identical to SEQ ID NO: 166109
  Homolog annotation: Hit_ID=NP_496969.1; Match level="QueryCoverage =78%, HitCoverage=7%, E-value=1e-12, Identity=45%"; Hit description =gene amplified in squamous cell carcinoma 1 like (2O526) [Caenorhabditis elegans] emb|CAB54451.1| Hypothet
  Coding regions on vcDNA: vcDNA=SeqID_95927; Strand=+; Position=41-304

SEQ ID NO: 169505 - protein, 106 aa, Heterodera glycines; identical to SEQ ID NO: 166108
  Coding regions on vcDNA: vcDNA=SeqID_95928; Strand=+; Position=2-322

SEQ ID NO: 169506 - protein, 133 aa, Heterodera glycines; identical to SEQ ID NO: 166107
  Coding regions on vcDNA: vcDNA=SeqID_95929; Strand=-; Position=90-491

SEQ ID NO: 169507 - protein, 158 aa, Heterodera glycines; identical to SEQ ID NO: 162689
  Homolog annotation: Hit_ID=NP_506352.1; Match level="QueryCoverage =93%, HitCoverage=94%, E-value=3e-47, Identity=61%"; Hit description =transthyretin-like protein precursor family member (17.8 kD) (5O10) [Caenorhabditis elegans] emb|CAB01136
  Coding regions on vcDNA: vcDNA=SeqID_95930; Strand=+; Position=1-477

SEQ ID NO: 169508 - protein, 79 aa, Heterodera glycines
  Homolog annotation: Hit_ID=CAE74118.1; Match level="QueryCoverage =73%, HitCoverage=93%, E-value=2e-17, Identity=68%"; Hit description =Hypothetical protein CBG21781 [Caenorhabditis briggsae]
  Coding regions on vcDNA: vcDNA=SeqID_95931; Strand=+; Position=21-260
MDSAAQFDHHQSFGGGTAPTRASTGGGIGTVSLGTVTYICGDCHKENEIRPKDPIRCRECGYRILYKKRSRKMMVYDAR

SEQ ID NO: 169509 - protein, 128 aa, Heterodera glycines
  Coding regions on vcDNA: vcDNA=SeqID_95932; Strand=+; Position=1-387
LKTGSKIVEKLIRMSTIPMPPPPTQDEKDQQKKSQWKPLEIGNRMRTTSEDSAESFDAYGPDSPNMTSSGRRMSITERLFGRPVPQERRNSLGEEQMGQEKPKSIAENKDFKELMKRQRKILGDDEWQ

SEQ ID NO: 169510 - protein, 208 aa, Heterodera glycines
  Homolog annotation: Hit_ID=NP_619610.1; Match level="QueryCoverage =100%, HitCoverage=50%, E-value=1e-106, Identity=88%"; Hit description=DEAD (Asp-Glu-Ala-Asp) box polypeptide 48 [Mus musculus] gb|AAH12862.1| DEAD (Asp-Glu-Ala-Asp) box poly
  Gene Ontology: Mol. function=helicase activity; Cellular component =eukaryotic translation initiation factor 4 complex; Biological process=nucleobase, nucleoside, nucleotide and nucleic acid metabolism
  Coding regions on vcDNA: vcDNA=SeqID_95933; Strand=+; Position=2-628
IYRYLPPNAQVVLLSATLPHDVLEMTSKFMTDPIRVLVKRDELTLEGIKQFFVAVEREEWKFDTLCDLYDTLTITQAVIFCNTRRKVDWLADKMREANFTVSSMHSDMEQKDRDAIMKSFRAGESRVLIGTDVWARGLDVPQVSLVINYDLPNNRELYIHRIGRSGRYGRKGVAINFVKNDDIRILRDIEQYYSTQIDEMPMNVSELI

SEQ ID NO: 169511 - protein, 154 aa, Heterodera glycines
  Coding regions on vcDNA: vcDNA=SeqID_95934; Strand=+; Position=17-478
FAVNLFSAATQILQYYRKNDLKMRTVQTARKSTGGMPPRKQTARKSAGGSGQRLQTARLPAAGGGEPILGTARRSAGGSGQRLQTARRSAGGAAPRPQTARRSAGGSGQRLQTARKAAAGPSLRNDVADEDDDDESVSEEMEESSEDNEPPQLV

SEQ ID NO: 169512 - protein, 196 aa, Heterodera glycines; identical to SEQ ID NO: 163152
  Homolog annotation: Hit_ID=CAE67374.1; Match level="QueryCoverage =58%, HitCoverage=7%, E-value=1e-10, Identity=31%"; Hit description =Hypothetical protein CBG12850 [Caenorhabditis briggsae]
  Coding regions on vcDNA: vcDNA=SeqID_95935; Strand=+; Position=37-624

SEQ ID NO: 169513 - protein, 169 aa, Heterodera glycines
  Coding regions on vcDNA: vcDNA=SeqID_95936; Strand=+; Position=3-509
LVFKPNAQMGRPFLPLAFSLVLLLLAVVISTNCANASPIVGEEQPMAPEQKATKGTNDGQMGDDNRTNRRNNMAAAQHQQQNRNATSLVALGWLGLRSGASSVNAVNVASCYDSRLSSFINDGLRYYSHNMGQLSKYIIDQIKRVRYSGYWFVHAAMIGGQTQGLQWQS

SEQ ID NO: 169514 - protein, 33 aa, Heterodera glycines
  Coding regions on vcDNA: vcDNA=SeqID_95937; Strand=-; Position=60-161
FFFFFFFQIASFIANNLRRNWPRDLYERVAQRL

SEQ ID NO: 169515 - protein, 52 aa, Heterodera glycines; identical to SEQ ID NO: 166101
  misc_feature (7)..(7): Xaa can be any naturally occurring amino acid
  misc_feature (23)..(23): Xaa can be any naturally occurring amino acid
  Homolog annotation: Hit_ID=AAL78230.1; Match level="QueryCoverage =100%, HitCoverage=58%, E-value=1e-22, Identity=96%"; Hit description= putative transitional endoplasmic reticulum ATPase [Heterodera glycines]
  Coding regions on vcDNA: vcDNA=SeqID_95938; Strand=+; Position=3-161

SEQ ID NO: 169516 - protein, 83 aa, Heterodera glycines
  Homolog annotation: Hit_ID=NP_960651.1; Match level="QueryCoverage =91%, HitCoverage=35%, E-value=2e-18, Identity=60%"; Hit description =hypothetical protein MAP1717 [Mycobacterium avium subsp. paratuberculosis str. k10] gb|AAS04034.1| hypoth
  Coding regions on vcDNA: vcDNA=SeqID_95939; Strand=+; Position=1-249
KPMRTSAYRHTALAGLAAVALITAGCTDDKDVDASMSPQVGLISTSTVQTPPHPAEVKLIGERDVEVTLTGPIAAKYKIKYRI

SEQ ID NO: 169517 - protein, 259 aa, Heterodera glycines
  Homolog annotation: Hit_ID=NP_495708.1; Match level="QueryCoverage =92%, HitCoverage=66%, E-value=1e-52, Identity=43%"; Hit description =protein c20orf4 homolog (2I437) [Caenorhabditis elegans] emb|CAA88309.1| Hypothetical protein F10B5.2 [Ca
  Coding regions on vcDNA: vcDNA=SeqID_95940; Strand=+; Position=25-801
MFLLPGKCRKNWRWNCSKTAIFKDFPKGCEFGMDYRSWIVGPNFLGMKMIPPGIHFIYFSVPGAPRIAFFHNFRQKEVILRRWDTKKEDLVTDEKSDEVELDRLRENLRNIDRFLGVYPFADYRNWLSLSSYITPNSVRRLSPSNSLGRISSQNEMVTQEAKLEKKLGDPFGLSIVDREHRGRIRFTDEGGLPLMSEGEEAKLNFTRISQITLADTNLRRAGIDSSDRLFQCFEAMGGDYREVLAEFQFAFVVFLVGQV

SEQ ID NO: 169518 - protein, 274 aa, Heterodera glycines
  Homolog annotation: Hit_ID=NP_496397.1; Match level="QueryCoverage =69%, HitCoverage=70%, E-value=2e-45, Identity=43%"; Hit description =interferon gamma inducible protein 30 like precursor (2L479) [Caenorhabditis elegans] emb|CAB04345.1| Hyp
  Gene Ontology: Biological process=regulation of protein activity, epigenetic
  Coding regions on vcDNA: vcDNA=SeqID_95941; Strand=+; Position=6-827
MMPKNFCGKTSKFSSCLLPALLLIIVLSILNSVSSSRRHHSPASGHNRRLSSISSPAVANGGSLFEHRTKHQSVAAADESAGGCAVVPPSLWCGCDKLQTQCGTGRLCGRYTGAMRNEPLHITLLYESLCPDCQSFITETLFDVYQKFKTHLRIEFVPFGNAKVLENGTIKCQHGPEECRINKFHSCAIHFMHDPMPFIYCLEKLISSGIPLEKASKKCYVKLHPIPHIYDQITHCFNGPTGDRLQREAGRLTAQIWPDQHEYVPWILENNASL

SEQ ID NO: 169519 - protein, 199 aa, Heterodera glycines
  Coding regions on vcDNA: vcDNA=SeqID_95942; Strand=+; Position=59-655
MHTTAAPPPHQPSVVMSAIDDNNSVRFPIIQVEVKIRVPDHLVGRLIGKSGICVKKIMEDTQSHISISESRSQQEVNQYQTPELLDRIITIRGTAFGSVMAAEKQVQQKLRYIQEQDMNISGGGGGVSAASGRQFCPTPVSAPPGGILQSMDGGGGAAIGSYIAPSAVTVTGAPMLSRGPPDNAFHHHPPTAAAMYSAQ

SEQ ID NO: 169520 - protein, 153 aa, Heterodera glycines
  Coding regions on vcDNA: vcDNA=SeqID_95943; Strand=+; Position=2-460
MNFNNVNIRKYDNKNERNGAGFGANSDTAAFESWACESFNLFEFLGEDTSPLDEVVPEKMDEDEIEKQKEDAMYSQFQYSDMLIGGQHPTNSHHDFGVNDFANVPSDGRSDFDVPTAFHEGVPFPMPPATHQIYSQNLDAIPHVPSTSKSSMP

SEQ ID NO: 169521 - protein, 96 aa, Heterodera glycines; identical to SEQ ID NO: 162511
  Homolog annotation: Hit_ID=NP_055278.1; Match level="QueryCoverage =94%, HitCoverage=89%, E-value=3e-34, Identity=75%"; Hit description =Lsm3 protein [Homo sapiens] ref|XP_216220.1| similar to U6 snRNA -associated Sm-like protein LSm3 (MDS017)
  Coding regions on vcDNA: vcDNA=SeqID_95944; Strand=+; Position=12-302

SEQ ID NO: 169522 - protein, 103 aa, Heterodera glycines; identical to SEQ ID NO: 163138
  Homolog annotation: Hit_ID=NP_509429.1; Match level="QueryCoverage =100%, HitCoverage=15%, E-value=5e-49, Identity=84%"; Hit description= transmembrane 9 superfamily member 2 (75.3 kD) (XJ38) [Caenorhabditis elegans] gb|AAB71307.1| Temporaril
  Gene Ontology: Cellular component=membrane; Biological process =transport
  Coding regions on vcDNA: vcDNA=SeqID_95945; Strand=+; Position=1-312

SEQ ID NO: 169523 - protein, 130 aa, Heterodera glycines
  Homolog annotation: Hit_ID=NP_494930.3; Match level="QueryCoverage =100%, HitCoverage=10%, E-value=1e-09, Identity=35%"; Hit description= putative protein of eukaryotic origin (84.8 kD) (2F343) [Caenorhabditis elegans] gb|AAK31510.3| Hypothet
  Coding regions on vcDNA: vcDNA=SeqID_95946; Strand=+; Position=14-406
MLLRMSDVISNGLGNHRPDNAFVFPTIAQHPNEIKPTNAMRSSNPLVGLASSRSSTTACSSLSGKDDDEQQLQKCSIDAATLCRNLIRFAYQLSAAKRRTLEDPELYRMRTHSKTEERLRRKVVRDMIME

SEQ ID NO: 169524 - protein, 135 aa, Heterodera glycines
  Homolog annotation: Hit_ID=NP_741502.1; Match level="QueryCoverage =59%, HitCoverage=32%, E-value=1e-32, Identity=75%"; Hit description =translation Initiation Factor 4E eIF4E (ife-3) [Caenorhabditis elegans] gb|AAM22022.1| Initiation factor
  Gene Ontology: Mol. function=translation initiation factor activity; Cellular component=ribosome; Biological process=regulation of cell cycle
  Coding regions on vcDNA: vcDNA=SeqID_95947; Strand=+; Position=71-475
MTSETVSSDASAAGGADKENTKTDTTTDPSSSENSASIEADHNNSKLRYADETTIIPHDLVERHFLQNTWALWYLKGDRNKNWTDCLKKVSTFDTVEDFWALYNHIQPASGLSWNSDYYLFKEGIKPMWEDKGNL

SEQ ID NO: 169525 - protein, 224 aa, Heterodera glycines
  Homolog annotation: Hit_ID=NP_727425.2; Match level="QueryCoverage =91%, HitCoverage=8%, E-value=8e-09, Identity=30%"; Hit description =CG17255-PB, isoform B [Drosophila melanogaster] ref|NP_572631.2| CG17255-PA, isoform A [Drosophila melanog
  Coding regions on vcDNA: vcDNA=SeqID_95948; Strand=+; Position=2-673
SSGQPGGGGPVVVHGGNAVNFAAAAAHQQQQQQAAGDPSQHVAAVHHHHQQQQQLPPQQNKTLFTPAANPAMVSATPAMQQHLQQQAQTIFHQTSATAVPQFPSYNMPYMYSPVATAQTLQGPNAEIDRFLIQQYGTPYSQLDLQMGAMSIGPPTSLAPNHHRATLESYMENKFGQQQQNVNQAANNGHYQQTQQSQQQQRGLAQSEQATLLGGPPSHVGPPPG

SEQ ID NO: 169526 - protein, 176 aa, Heterodera glycines; identical to SEQ ID NO: 162381
  Homolog annotation: Hit_ID=CAE66687.1; Match level="QueryCoverage =93%, HitCoverage=97%, E-value=1e-62, Identity=69%"; Hit description =Hypothetical protein CBG12026 [Caenorhabditis briggsae]
  Gene Ontology: Mol. function=iron ion binding; Cellular component =ferritin complex; Biological process=iron ion homeostasis
  Coding regions on vcDNA: vcDNA=SeqID_95949; Strand=+; Position=45-575

SEQ ID NO: 169527 - protein, 72 aa, Heterodera glycines
  Coding regions on vcDNA: vcDNA=SeqID_95950; Strand=-; Position=2-217
PHLLHIRVKDIAKVPVVVLVDQFLRGNELIFVHFELIRFHLHQTVFGIHKFRCSKHFRIKKAFRFILTMGLI

SEQ ID NO: 169528 - protein, 90 aa, Heterodera glycines; identical to SEQ ID NO: 166090
  Coding regions on vcDNA: vcDNA=SeqID_95951; Strand=-; Position=3-272

SEQ ID NO: 169529 - protein, 83 aa, Heterodera glycines; identical to SEQ ID NO: 166089
  Coding regions on vcDNA: vcDNA=SeqID_95952; Strand=+; Position=2-253

SEQ ID NO: 169530 - protein, 315 aa, Heterodera glycines
  Homolog annotation: Hit_ID=AAH74536.1; Match level="QueryCoverage =98%, HitCoverage=92%, E-value=1e-38, Identity=32%"; Hit description =MGC69286 protein [Xenopus tropicalis] ref|NP_001004796.1| MGC69286 protein [Xenopus tropicalis]
  Coding regions on vcDNA: vcDNA=SeqID_95953; Strand=+; Position=2-949
HSIQTLSAWLLHHAKKHADCILDCWLKEVRNNSENERLISLINLANDVIQNSRKKVPSFMAAFFEVLQPAFVHASECLDESHRKMVARIVAVWRERQIYSAKNLDDLSKCLTADEPSTFSVSPNLNSETESPSKSSPVDGGQSPVASEEDTKKIKEEFHAFSTLSSNMIALLRKLEDPASTDVKIRQLIAAYPESIANPTLLKQFKSADEFGELSKKIAEAMPVVDVYCGRLREELKDRQNFQFLLEDYIKALNEANERNKQLVVSVKRRIGRLDEEKQELARHIESLPDLTEMFGSEPATTNLSSLGELFTPTS

SEQ ID NO: 169531 - protein, 148 aa, Heterodera glycines
  Homolog annotation: Hit_ID=NP_491946.1; Match level="QueryCoverage =86%, HitCoverage=38%, E-value=6e-11, Identity=33%"; Hit description =putative nuclear protein, with 2 coiled coil domains (39.7 kD) (1H376) [Caenorhabditis elegans] gb|AAB524
  Coding regions on vcDNA: vcDNA=SeqID_95954; Strand=+; Position=85-528
MADEQEETQVAPPQPVLHTENVSSFLDLQTEFIKRRDAAIAGKSQSFATEPMHRRTPRNNILAISKEEKKAKSEVSTLRVYLIRQNEEAIRKEEQQRAKQQQILQQKAAIYERMAKGERLVYDDGKEAEFLVDFHAKKKELEEEARNK

SEQ ID NO: 169532 - protein, 162 aa, Heterodera glycines
  Homolog annotation: Hit_ID=CAE72576.1; Match level="QueryCoverage =71%, HitCoverage=26%, E-value=5e-38, Identity=66%"; Hit description =Hypothetical protein CBG19763 [Caenorhabditis briggsae]
  Coding regions on vcDNA: vcDNA=SeqID_95955; Strand=+; Position=3-488
FNEVGSRDALFLLSVLQLHLTISVNIATIITPKFMISSDSHRRALGDIAGMGVSGRAHPSLAKMRENLINGTIDFQEVPIIDMNPEDIRAELKRVYTQLRMYKLKNAYQDNPHISKRKGGGAVKKSAAGDATVSGRLSSGAGLSGAGLPKGVRGTEGYCAVK

SEQ ID NO: 169533 - protein, 163 aa, Heterodera glycines
  misc_feature (41)..(41): Xaa can be any naturally occurring amino acid
  misc_feature (151)..(151): Xaa can be any naturally occurring amino acid
  Homolog annotation: Hit_ID=CAE64114.1; Match level="QueryCoverage =95%, HitCoverage=45%, E-value=7e-11, Identity=27%"; Hit description =Hypothetical protein CBG08723 [Caenorhabditis briggsae]
  Coding regions on vcDNA: vcDNA=SeqID_95956; Strand=+; Position=22-510
MLESDTSGEQLQLLRTIVDSHLTNGQTFFVPWSDKRALQSXFLPFKELANQGVALEFIIDACSKSVALFMALTKNGRETTKKLGVFVDCMEMTYEDAMRFYAKWASGLEEVSADCVQQRLSIFLGRGVRAGAQMRSVVMRCPEILFMGVPXQMDMFWENILDF

SEQ ID NO: 169534 - protein, 142 aa, Heterodera glycines
  Coding regions on vcDNA: vcDNA=SeqID_95957; Strand=+; Position=53-478
QFLVKMFGGGGDPFRNPFDQMHQQMRQMDNMMNSMLGDAWDMLNGFGMMGPPFPNHPMLTDGLNRQNQALRRQQPPQHHFGPDTMMSPFGGFGLFGGMMQQMQNMHNHAISDPNSVVFSESTMVSYDGNGQPKVVQHSTRKA

SEQ ID NO: 169535 - protein, 249 aa, Heterodera glycines
  Homolog annotation: Hit_ID=NP_504654.1; Match level="QueryCoverage =88%, HitCoverage=98%, E-value=4e-46, Identity=44%"; Hit description =ubiquitin -terminal (23.5 kD) (5G990) [Caenorhabditis elegans] gb|AAD14718.1| Ubiquitin c-terminal hydrol
  Gene Ontology: Mol. function=peptidase activity; Cellular component =nucleus; Biological process=protein deubiquitination
  Coding regions on vcDNA: vcDNA=SeqID_95958; Strand=+; Position=3-752
ILAGEEKRITWVPLESNPEAFNKYIEKMGVKGVECHELFGFEPDLVSFVPGPHLALIFCYPYQDKANDYQKGIYGQLTASDKGGVPEWAFFMKQKIHNACGTFALFHALTNNTDRIDIGNGVFYDWFKAAKQLNVEQRSDLLANDSELAHLHEHCALRESETDVPRNVAHHFISYFTHGGRLFEFDSGQEFPRDCGPSSEETLLTDAGKICKELMGQLEDISCNAIALCAQNNLIDEMTKKILRYSRVF

SEQ ID NO: 169536 - protein, 76 aa, Heterodera glycines
  Homolog annotation: Hit_ID=EAA71081.1; Match level="QueryCoverage =100%, HitCoverage=99%, E-value=7e-35, Identity=97%"; Hit description= hypothetical protein FG08768.1 [Gibberella zeae PH-1] ref|XP _388944.1| hypothetical protein FG08768.1 [Gi
  Gene Ontology: Biological process=cell cycle
  Coding regions on vcDNA: vcDNA=SeqID_95959; Strand=+; Position=1-231
QIFVKTLTGKTITLEVESSDTIDSVKTKIQDKEGIPPDQQRLIFAGKQLEDGRTLSDYNIQKESTLHLVLRLRGGQ

SEQ ID NO: 169537 - protein, 71 aa, Heterodera glycines; identical to SEQ ID NO: 166082
  Homolog annotation: Hit_ID=NP_491688.1; Match level="QueryCoverage =97%, HitCoverage=10%, E-value=5e-10, Identity=39%"; Hit description =high Mobility Group protein (hmg-3) [Caenorhabditis elegans] gb|AAC24268.1| Hmg protein 3 [Caenorhabditis
  Coding regions on vcDNA: vcDNA=SeqID_95960; Strand=+; Position=2-217

SEQ ID NO: 169538 - protein, 215 aa, Heterodera glycines
  Homolog annotation: Hit_ID=NP_501650.1; Match level="QueryCoverage =95%, HitCoverage=51%, E-value=8e-75, Identity=63%"; Hit description =aminoacylase family member (4K139) [Caenorhabditis elegans] emb|CAA92445.1| Hypothetical protein C10C5.3
  Gene Ontology: Mol. function=aminoacylase activity; Cellular component=cytosol; Biological process=amino acid metabolism
  Coding regions on vcDNA: vcDNA=SeqID_95961; Strand=+; Position=6-650
MQSAEETMALVAVTKFRDYLRINTEQPNPDYHKCRDFLFTYATELGFMPWEYECVPGKPMVGMTYAGSDQTLPSLLLYSHTDVVPTFPEHWTYPPYEAFKDIDGNIFGRGAQDMKCVGIQYMEALREILFENGQKPFLRTVHILWGPDEEIGSHDGMEKFVHTDKFRSLNIGFALDERLASETDTYSVFYGERCAWWLQITCPGAPGHGSRFVEN

SEQ ID NO: 169539 - protein, 206 aa, Heterodera glycines
  Homolog annotation: Hit_ID=CAE69691.1; Match level="QueryCoverage =100%, HitCoverage=49%, E-value=5e-90, Identity=75%"; Hit description= Hypothetical protein CBG15946 [Caenorhabditis briggsae]
  Gene Ontology: Mol. function=acyl-CoA dehydrogenase activity; Cellular component=mitochondrial matrix; Biological process=energy pathways
  Coding regions on vcDNA: vcDNA=SeqID_95962; Strand=+; Position=3-620
FDLSDQHKAIQDGALKFAKEVVAPKAAEYDKTMAFPWDIIKQAHQLGLMNPTIPEKYGGPGCSNLETALIVEALSYGCSAIQLAIMGPSLALAPLLLAGNETQKQKYAGMLAAEPLIAAYCVTEPGAGSDVSGVKTTAVLKGDKWVLNGSKAWITGGGYAKWFFVLARSDSDPKTPAGKAFTAFVVDGDTPGITRGKKEINMGQRC

SEQ ID NO: 169540 - protein, 147 aa, Heterodera glycines
  Homolog annotation: Hit_ID=XP_216480.1; Match level="QueryCoverage =97%, HitCoverage=89%, E-value=9e-33, Identity=46%"; Hit description =similar to RIKEN cDNA 0610037L13 [Rattus norvegicus]
  Coding regions on vcDNA: vcDNA=SeqID_95963; Strand=+; Position=44-484
MPVFALQMSANLVGVTDLRPSDYDDHRWYLKLKCSACGESYPSEQYANTRETHTLTKGKGICHISAKCSFCGRINSLEILIDSYASYSADKNRLFQTLVKFECRGIEPTSFDPRIGWICVGTESGSIFDEIDLNELEWADYDEKNSS

SEQ ID NO: 169541 - protein, 83 aa, Heterodera glycines; identical to SEQ ID NO: 163116
  Coding regions on vcDNA: vcDNA=SeqID_95964; Strand=+; Position=20-271

SEQ ID NO: 169542 - protein, 181 aa, Heterodera glycines
  Coding regions on vcDNA: vcDNA=SeqID_95965; Strand=+; Position=3-548
RPRVHHRTVLSSLSLLLNINNNNSSSSRRCRRRRTVLLRLLFLVRVPPLPSLRLPLFLRQHLQQFHQQQLNNSNNNHRHQRSRIITVTISPSSRNQPLRSLSLHSCDTLVNVPVKMGMPWCKSLSNSLLFLSNSVHWLLNSLIILWQLRARMCKFGERETQRKSASLIFFCVILFIDYHLN

SEQ ID NO: 169543 - protein, 346 aa, Heterodera glycines
  Homolog annotation: Hit_ID=CAE59922.1; Match level="QueryCoverage =99%, HitCoverage=37%, E-value=4e-70, Identity=40%"; Hit description =Hypothetical protein CBG03408 [Caenorhabditis briggsae]
  Gene Ontology: Cellular component=membrane; Biological process =intracellular protein transport
  Coding regions on vcDNA: vcDNA=SeqID_95966; Strand=+; Position=1-1041
LKVSVVGLERALEQYTSAAHFDAPFDLKQVPLSTEPLTASTDEVKKKAAMVDDASAAMKKQKEEKKSGTSRQEQFALQFASMPEFAACGALFKSCAAVELTETITEYNVSCVKHIFNDDFVLLQFDCRNTLNDQLLEEVFVEIEPQDEGEDCPWHVQSVHPLAQLPFGQPCTTYVLLKMPEDGRIAGTFGAKLKFKICDVDPATGEPESNDLYDEVYTLEPIDVGLADFLLAIAPKGASFTTAWDALKEEGHETEESYALSNVHTLEDAVSKLLKCTALFPCEHSNRVPEGKSSHQLLLCGIFRGGIDVLCRVRLVMDPSDQTVSMNMVVRSMDETVSQMIANIVS

SEQ ID NO: 169544 - protein, 197 aa, Heterodera glycines; identical to SEQ ID NO: 162231
  Coding regions on vcDNA: vcDNA=SeqID_95967; Strand=+; Position=3-596

SEQ ID NO: 169545 - protein, 194 aa, Heterodera glycines
  misc_feature (185)..(185): Xaa can be any naturally occurring amino acid
  Homolog annotation: Hit_ID=CAE68855.1; Match level="QueryCoverage =97%, HitCoverage=99%, E-value=8e-73, Identity=69%"; Hit description =Hypothetical protein CBG14817 [Caenorhabditis briggsae]
  Coding regions on vcDNA: vcDNA=SeqID_95968; Strand=+; Position=44-626
MSSAERKIDVNRTNYSVVDSEFDSMRERFEKEMRRVDEEMQRLRHEFEGYRPAASRSSPYTTAGTQPIYGGGSSLSNGAGGGAMARHSPTYDPYLENLKSPLIKDESDGKTLRLRFDVAQYRPEEVTVKTVDNRLLVHAKHEEKTPSRTVYREYNQEFMLPRGTNPEQISSTLSTDGVLTVEAPXLPQLAIQNH

SEQ ID NO: 169546 - protein, 140 aa, Heterodera glycines; identical to SEQ ID NO: 166080
  Coding regions on vcDNA: vcDNA=SeqID_95969; Strand=+; Position=3-425

SEQ ID NO: 169547 - protein, 142 aa, Heterodera glycines
  Coding regions on vcDNA: vcDNA=SeqID_95970; Strand=+; Position=3-428
PFAVSPSFNFLRRPFPLLVFRRSLFKPPLDSPFCGIYRTKMATKNGRIPYELLFELISALPFHIRWAVTRVSKAFDGFVWQKQFSWVRAELIRKEAQRQKEGGAFLQMVDSLSTAVNSLSEASHSLSQASHSLSNSAAQEMH

SEQ ID NO: 169548 - protein, 138 aa, Heterodera glycines; identical to SEQ ID NO: 162468
  Homolog annotation: Hit_ID=NP_510159.1; Match level="QueryCoverage =83%, HitCoverage=91%, E-value=1e-31, Identity=54%"; Hit description =putative nuclear protein of bilaterial origin (14.2 kD) (XN606) [Caenorhabditis elegans] emb|CAA91025.1|
  Coding regions on vcDNA: vcDNA=SeqID_95971; Strand=+; Position=112-528

SEQ ID NO: 169549 - protein, 154 aa, Heterodera glycines
  Coding regions on vcDNA: vcDNA=SeqID_95972; Strand=+; Position=1-462
LLKTFDPLQISAKMLHSFRGVRLSSHTNNTFEFSSSFSSSTSTTTKRTKSSNSNEDGRTPTNGKNLSPKKRNHSQQRQQQNDSKKSALSTDLGLKSVVVQRKLNIQTNYSLRAVRKKITASNELVVEQDEGVAKAKPPNEHRYKRAAKDENEND

SEQ ID NO: 169550 - protein, 278 aa, Heterodera glycines
  Homolog annotation: Hit_ID=NP_498608.1; Match level="QueryCoverage =51%, HitCoverage=75%, E-value=1e-39, Identity=56%"; Hit description =n/apple PAN precursor (22.0 kD) (3I388) [Caenorhabditis elegans] gb|AAK18868.1| Hypothetical protein B036
  Coding regions on vcDNA: vcDNA=SeqID_95973; Strand=+; Position=12-848
MIFNHFYTQFYILLNVLASTGFVFCTTEWFGDLRAHMNPPKFPPFYDIVYDEPDCPFGLESVAIPEFVYFGEMIATKFVQEHSQCLQFCLETSKCKAVNFFESIEGKNPEVGFCELLVEGQYDNPRLMRPFKKATYHEKIHCRAENEEEKQPFIFDEKDGKQLLIGNESNERKNTSSTAKQTEKGTNENGQKTTAENRQSEGRMNEQRSQKTTEKQPRREEQSEGRGFFCRKTETKEETAQKSETQEKATEPPTAQLNSLILKRLAERIQELKKRFRN

SEQ ID NO: 169551 - protein, 83 aa, Heterodera glycines; identical to SEQ ID NO: 163578
  Coding regions on vcDNA: vcDNA=SeqID_95974; Strand=+; Position=55-306

SEQ ID NO: 169552 - protein, 185 aa, Heterodera glycines
  Homolog annotation: Hit_ID=NP_780438.1; Match level="QueryCoverage =97%, HitCoverage=6%, E-value=1e-09, Identity=32%"; Hit description =serine/arginine repetitive matrix 2 [Mus musculus] dbj|BAC41104.1| unnamed protein product [Mus musculus]
  Coding regions on vcDNA: vcDNA=SeqID_95975; Strand=+; Position=161-718
MTSSRSRTRRTTTNAASTAAAGRSRSRSTHTGRRSASRRAIGNRATGRSSSVMNASRRVSRRVSSARKSSRRRRRIVARRATPKKRSKSAKKRGRGRPRKPQRGRSARAQRRITITQGVLDVPGHGQMTEAELREIFMAGTTANEPTNRPLGGAEVITTTNANNRTTGGNATSSSSSSPSLSDSV

SEQ ID NO: 169553 - protein, 159 aa, Heterodera glycines
  misc_feature (73)..(73): Xaa can be any naturally occurring amino acid
  misc_feature (105)..(105): Xaa can be any naturally occurring amino acid
  misc_feature (113)..(113): Xaa can be any naturally occurring amino acid
  Homolog annotation: Hit_ID=CAE64449.1; Match level="QueryCoverage =77%, HitCoverage=88%, E-value=3e-24, Identity=46%"; Hit description =Hypothetical protein CBG09156 [Caenorhabditis briggsae]
  Coding regions on vcDNA: vcDNA=SeqID_95976; Strand=+; Position=1-474
FSSYTKKKKCFHLSIFVTLCLLISCLIPFSFDYDDDLFEIGTAQSVAVTGILTCNGRPSGGTKVKLYDVDTFXPDDLMAEGFTDEKEHFLLEGFETEISDIDSKXNIYHNCNXRTYPCLQKFSIEIPDNYITEEKRSPQKIFYIGKLNLEGKFSGQHRD

SEQ ID NO: 169554 - protein, 149 aa, Heterodera glycines
  Homolog annotation: Hit_ID=CAE64449.1; Match level="QueryCoverage =79%, HitCoverage=86%, E-value=5e-29, Identity=49%"; Hit description =Hypothetical protein CBG09156 [Caenorhabditis briggsae]
  Coding regions on vcDNA: vcDNA=SeqID_95977; Strand=+; Position=100-546
MAANTTQYRGHFVYSLAKLTPSSFGYDDDDLFDIGTAQSVAVTGILTCNGRPSGGTKVKLYDVDTFDPDDLMAEGFTDEKGHFLLEGFEMEISDIDPKLNIYHNCNDEHFPCLQKFSIEVPDNYITEGKRPQKIFDIGKLNLEGKFSGQ

SEQ ID NO: 169555 - protein, 232 aa, Heterodera glycines; identical to SEQ ID NO: 162327
  Homolog annotation: Hit_ID=CAE72053.1; Match level="QueryCoverage =36%, HitCoverage=13%, E-value=2e-10, Identity=39%"; Hit description =Hypothetical protein CBG19139 [Caenorhabditis briggsae]
  Coding regions on vcDNA: vcDNA=SeqID_95978; Strand=+; Position=1-696

SEQ ID NO: 169556 - protein, 100 aa, Heterodera glycines
  Coding regions on vcDNA: vcDNA=SeqID_95979; Strand=-; Position=122-424
NENKNEMGYEIETFWFLFLMFGKALSLSKRIFKSDGLSKFVQNLKAVKFPSKVSTRTHKESKKISSQFVKKKSRLFKQWIFNLVRCPLCDNEQRGGRNAR

SEQ ID NO: 169557 - protein, 160 aa, Heterodera glycines
  Homolog annotation: Hit_ID=AAC98796.1; Match level="QueryCoverage =89%, HitCoverage=59%, E-value=8e-55, Identity=69%"; Hit description =dolichol monophosphate mannose synthase [Caenorhabditis briggsae]
  Gene Ontology: Mol. function=dolichyl-phosphate beta-D -mannosyltransferase activity; Cellular component=nuclear envelope -endoplasmic reticulum network; Biological process=protein amino acid glycosylation
  Coding regions on vcDNA: vcDNA=SeqID_95980; Strand=+; Position=34-513
MDDSHQDNGRKQQNTFLTPKFSILLPTYNEAENLPICLWLIIKYLKGLSYEVIIIDDNSPDGTQEVAKSLQKEFGAGRIKLLTRECKLGLGSAYVFGLKQAQGEFVILMDADLSHHPRHIPEMVTLQEKHGYDIVTGTRYAMGGGVSGWDFRRKMISRGA

SEQ ID NO: 169558 - protein, 167 aa, Heterodera glycines
  Coding regions on vcDNA: vcDNA=SeqID_95981; Strand=+; Position=3-503
APQASPHVAFDYGATKLAAAAPSSYGSASEAQPAPAGDENGTKEVSQRKNATPAQTAQHNNAPPQQPARQTTAAQNVLEQRRAKRRCPREAGFVQADAASGGGMHSPAAAARISHRVIGHTAPSTEYASGPRPAGTDAPRVYAAQPYAAPTRSISSVSKSRGSIGPE

SEQ ID NO: 169559 - protein, 223 aa, Heterodera glycines; identical to SEQ ID NO: 163025
  misc_feature (181)..(181): Xaa can be any naturally occurring amino acid
  Homolog annotation: Hit_ID=NP_508615.1; Match level="QueryCoverage =91%, HitCoverage=57%, E-value=1e-31, Identity=38%"; Hit description =choline/ethanolamine kinase (39.7 kD) (XE193) [Caenorhabditis elegans] gb|AAB52502.1| Choline kinase c pr
  Gene Ontology: Mol. function=ethanolamine kinase activity; Cellular component=cytoplasm; Biological process=phosphatidylethanolamine biosynthesis
  Coding regions on vcDNA: vcDNA=SeqID_95982; Strand=+; Position=3-673

SEQ ID NO: 169560 - protein, 58 aa, Heterodera glycines
  Coding regions on vcDNA: vcDNA=SeqID_95983; Strand=+; Position=26-199
MGTKNGRIPYELLFELISALPFDIRWAVTRVSKAFDGFVWQKQFSWVRAELTRKEAAR

SEQ ID NO: 169561 - protein, 236 aa, Heterodera glycines
  misc_feature (12)..(12): Xaa can be any naturally occurring amino acid
  misc_feature (16)..(16): Xaa can be any naturally occurring amino acid
  Homolog annotation: Hit_ID=JC4382; Match level="QueryCoverage=100%, HitCoverage=58%, E-value=1e-103, Identity=78%"; Hit description =ribosomal protein L3.e, cytosolic - Toxocara canis gb|AAA92285.1| ribosomal protein L3 sp|P49149|RL3_TOXCA 6
  Gene Ontology: Mol. function=structural constituent of ribosome; Cellular component=ribosome; Biological process=protein biosynthesis
  Coding regions on vcDNA: vcDNA=SeqID_95984; Strand=+; Position=39-745
MSHRKFSAPRHXSMGXFTPKKRAKRHRGKVKAFPKDDPKKPIHLTAFIAYKAGMSHIVRDVDKLGSKVHKKEVVEAVTILETPPMVIVGVVGYIETPRGPRPLKTVFAEHLSEDCKRRFYKNWYKCKKKAFTKYAKKWQDEAGQKSIEADLNKIKKYCSYVRVIAHTQMKLMKHRNKKAHIMEIQINGGTVAEKVDWAREHFEKQGPRGAVCELATPSTASVSQRKGLKGVTSGWH

SEQ ID NO: 169562 - protein, 121 aa, Heterodera glycines
  Coding regions on vcDNA: vcDNA=SeqID_95985; Strand=-; Position=1-363
CLFPLSVCLFFSLSFFRPLSLALSFLFLSLSALLAISIESVVLFRWAELGIFGSGTDQSAFVGRAISQGNFAVRHAHQILRLIVQTLAETISERDVAFVATGGGGLIGIVGLVKGREKKKK

SEQ ID NO: 169563 - protein, 158 aa, Heterodera glycines
  Homolog annotation: Hit_ID=NP_740855.1; Match level="QueryCoverage =100%, HitCoverage=12%, E-value=8e-62, Identity=69%"; Hit description= splice (1G205) [Caenorhabditis elegans] gb|AAK21388.1| Hypothetical protein F46F11.1a [Caenorhabditis el
  Gene Ontology: Cellular component=Arp2/3 protein complex; Biological process=actin cytoskeleton organization and biogenesis
  Coding regions on vcDNA: vcDNA=SeqID_95986; Strand=+; Position=3-476
DGKVERDADGKEVRYPVILSAKEKTIARRVVLAFGQSVCGFDLLRANGCSYVCDVNGFSFVKTSTKYYEDTAKILGNTILRRLASSLSIPWHIPFQDDDPPLVSTPSGKIMELRCVLAVIRHGDRTPKQKMKVAVKDERFWNMFKKYDGPRKRELKLK

SEQ ID NO: 169564 - protein, 91 aa, Heterodera glycines; identical to SEQ ID NO: 165839
  Coding regions on vcDNA: vcDNA=SeqID_95987; Strand=-; Position=1-273

SEQ ID NO: 169565 - protein, 153 aa, Heterodera glycines
  Homolog annotation: Hit_ID=AAH63190.1; Match level="QueryCoverage =98%, HitCoverage=32%, E-value=1e-23, Identity=34%"; Hit description =Hypothetical protein MGC75576 [Xenopus tropicalis] ref|NP_989221.1| hypothetical protein MGC75576 [Xenopus
  Gene Ontology: Mol. function=protein binding; Biological process =ubiquitin cycle
  Coding regions on vcDNA: vcDNA=SeqID_95988; Strand=+; Position=18-476
MSESASDDENAHLIEIKFKTIQETYNVKVNENSTIKQLKKTMAKKLNQPEEKICLIFSGKILKDHENLSQHHIGDGMVLHMVIRNQPSTSTASAATTSSVSTAPTGGAAPNLAGTPPSLGGIGDLFNNPELVQGILNSPFMESMLANPDIIRT

SEQ ID NO: 169566 - protein, 158 aa, Heterodera glycines
  Homolog annotation: Hit_ID=NP_499187.1; Match level="QueryCoverage =90%, HitCoverage=45%, E-value=9e-61, Identity=76%"; Hit description =solute carrier family 25 member 1 (34.2 kD) (3K943) [Caenorhabditis elegans] emb|CAA80178.1| Hypothetical
  Gene Ontology: Mol. function=citrate transporter activity; Cellular component=mitochondrial inner membrane; Biological process =mitochondrial citrate transport
  Coding regions on vcDNA: vcDNA=SeqID_95989; Strand=+; Position=3-476
SIPKSAFRFGTFEFLKGHAVDERGNLSPFMRLACGLGAGISEAIFAVTPMETVKVKFIHDQTLEKPRFRGFMHGMGVIMKADGPRGFYQGLTATMAKQGSNQAIRFFVMETLKDWYRDGDPNVPVSKPVVGLFGAIAGAASVYVAFAIVTILFFYFRP

SEQ ID NO: 169567 - protein, 76 aa, Heterodera glycines
  Homolog annotation: Hit_ID=XP_509213.1; Match level="QueryCoverage =81%, HitCoverage=10%, E-value=4e-09, Identity=50%"; Hit description =PREDICTED: similar to cleavage and polyadenylation specific factor 6, 68 kD subunit; pre-mRNA cleavage fa
  Gene Ontology: Mol. function=RNA binding; Cellular component=nucleus; Biological process=mRNA processing
  Coding regions on vcDNA: vcDNA=SeqID_95990; Strand=+; Position=3-233
DDRCKLLVNTLQDTLKGIEAQSYNGGGAGLSRKHRVRDRSRSPIRSSKRHRRSRSRSRSRDYSPMRYSSAVSSRRF

SEQ ID NO: 169568 - protein, 211 aa, Heterodera glycines
  misc_feature (160)..(160): Xaa can be any naturally occurring amino acid
  Homolog annotation: Hit_ID=NP_492210.1; Match level="QueryCoverage =93%, HitCoverage=47%, E-value=2e-67, Identity=64%"; Hit description =i-67 protein (1I607) [Caenorhabditis elegans] pir||T23321 hypothetical protein K04G2.2 - Caenorhabditis e
  Coding regions on vcDNA: vcDNA=SeqID_95991; Strand=+; Position=31-664
MTATTIAQDPTPSPRRVFLRDLCSLFCCPPLPSAIVAKLAFMPPEPSYRILTNDSGRTTLELIDGRTEWPHGQDELNNVEVFFTRTQRRNKIACMFVRPFELSHFTLLFSHGNAVDIGQMCNFYLGLGCRLRCNVFSYDYSGYGQSTGRPSEKNLYADIXAALKSLESRYQIPPEQVILYGQSIGTVPSIDLASCNPRIAGLVLHSPLLSG

SEQ ID NO: 169569 - protein, 186 aa, Heterodera glycines
  misc_feature (111)..(111): Xaa can be any naturally occurring amino acid
  Homolog annotation: Hit_ID=NP_510638.2; Match level="QueryCoverage =95%, HitCoverage=60%, E-value=2e-48, Identity=51%"; Hit description =solute carrier family 25 member 21 (31.8 kD) (XQ807) [Caenorhabditis elegans] emb|CAB04651.3| Hypothetica
  Gene Ontology: Mol. function=intracellular transporter activity; Cellular component=mitochondrial membrane; Biological process =mitochondrial transport
  Coding regions on vcDNA: vcDNA=SeqID_95992; Strand=+; Position=183-741
MTNVLNSPMLEGIKDSGRHFVSGGIAGMAEVCFAHPFDCMKTRLQIGQFHGILDCARRTLLNEGPSGFYKGLLPPLVIETPKRALKFMAFDRYWRVLRSDALPTWLVIESXSMSGLFTGLTEAVLVCPFEVVKVRLQSELNTPFFQQKSSATVAREIVHSNGWGTEGLYRGIGANLWRHGVWNSCY

SEQ ID NO: 169570 - protein, 190 aa, Heterodera glycines
  Coding regions on vcDNA: vcDNA=SeqID_95993; Strand=+; Position=48-617
MEVEVEAVAEAEAEEELDPKGRVQQLLEMGKSLEWEMAVQSDDEQILDLDDDLEMFPRLIFLQLAKFLKNAPDGLNEQQKKELKKVLVNWMEEQKQPFTVDEEMAQVDETVQSLSTFCDQIGKSFKGTPAILDIFLDFHKNETLETEKLEFMWKMVNRKVTHYVKSVGQFYGGIKIAKENLKQVKKIGKW

SEQ ID NO: 169571 - protein, 242 aa, Heterodera glycines
  Coding regions on vcDNA: vcDNA=SeqID_95994; Strand=+; Position=15-740
NLFLFYTHAISPMSTNRGRGRVSLPKDHSQTSEYGGRGRGMYSFHQPDVKESSQIAGRGRGTTLQQKTEHGGGYSMGMQQQQEISPMRGPRGGRGHDVSGHGLDRHPVAPTMPSPVPFGGVSAVQPTSGRGQLPSMSRYGAYAAFTKQRDQLDQQKAVLEEVATRLEEHKGEETSVGSQAEEVTSTTLQRGLLQHEVGGMEAQQMVVGEQAQCPSAEGVPHAFLCAGCQFRADCANLLRAIG

SEQ ID NO: 169572 - protein, 268 aa, Heterodera glycines
  Coding regions on vcDNA: vcDNA=SeqID_95995; Strand=+; Position=1-807
RKYFFKTYFYFILTIFSSMSTNRGRGRVSLPSGDHSQTSEYGGRGRGMYSFHQQDVKESSAGRGRGTTLQQKTEHGGGYSMGMQQQQEISPMRGPRGGRGHGVSGHGLDRHPVAPTMPSPVPFGGFPAVQPTSGRGQLPSMSRYGAYAAFTKQRDQMDQQKAVLEEVATRLEEHKGDETSVESQAEEVTSTTLQRGLLQHEVGGMEEQQMVVGEQAQCPSAEGVPHAFLCAGCQFRADCANLLRAIGALLKDFGSAASVDGGRNNGTT

SEQ ID NO: 169573 - protein, 215 aa, Heterodera glycines
  misc_feature (67)..(67): Xaa can be any naturally occurring amino acid
  misc_feature (91)..(91): Xaa can be any naturally occurring amino acid
  misc_feature (110)..(110): Xaa can be any naturally occurring amino acid
  misc_feature (136)..(136): Xaa can be any naturally occurring amino acid
  misc_feature (145)..(145): Xaa can be any naturally occurring amino acid
  Homolog annotation: Hit_ID=CAB88203.1; Match level="QueryCoverage =95%, HitCoverage=95%, E-value=6e-73, Identity=61%"; Hit description =putative cuticular collagen [Globodera pallida]
  Gene Ontology: Mol. function=structural constituent of cuticle; Cellular component=extracellular; Biological process=reproduction
  Coding regions on vcDNA: vcDNA=SeqID_95996; Strand=+; Position=6-650
MQETHIVLGIASVCSLLAIIATVVTLPSLYSEMSQMNSKVRDGVEAFRVNTDSAWTDLMDVQVVVTXPPSKPRDNPFNSIFRAKRQLPGHXASAPGLQQPSCPPGPPRPXGRPGQPGQPGGARQPRQPGKPGQPAXPCPAPNIPXAPCPGWAPPAAPEGKGTARATKGAPGKPGNPPLQGGGTWKTLGAPGPQGKTWGNPGNPPKALCNPRKTWE

SEQ ID NO: 169574 - protein, 62 aa, Heterodera glycines
  Coding regions on vcDNA: vcDNA=SeqID_95997; Strand=-; Position=3-188
PLINCLLSANCLAFQLFDAPLFFLWRCRSVFFFVSFWPFVTVRFGTHLSIRDCAASPPLTER

SEQ ID NO: 169575 - protein, 174 aa, Heterodera glycines; identical to SEQ ID NO: 162415
  Coding regions on vcDNA: vcDNA=SeqID_95998; Strand=-; Position=190-714

SEQ ID NO: 169576 - protein, 29 aa, Heterodera glycines
  Coding regions on vcDNA: vcDNA=SeqID_95999; Strand=+; Position=1-90
ENGGPGVAGEIGNMGTCDHCPTPRTAPGY

SEQ ID NO: 169577 - protein, 138 aa, Heterodera glycines
  Coding regions on vcDNA: vcDNA=SeqID_96000; Strand=-; Position=2-418
GELGTGPPLEFFIFFFFFFLKSDHLLEGKNRFMHLIIEIWKKGLKWGRKGGIKLKMNVYFFGIHPEFFFFFFFTHSLHSLFTNAQNALIPSAATGTDVERCFGFLPAFVHFLVVPTGHLFIPISRSTSCRIPAARGIH

SEQ ID NO: 169578 - protein, 120 aa, Heterodera glycines
  misc_feature (36)..(36): Xaa can be any naturally occurring amino acid
  Homolog annotation: Hit_ID=CAE73993.1; Match level="QueryCoverage =99%, HitCoverage=36%, E-value=1e-25, Identity=42%"; Hit description =Hypothetical protein CBG21626 [Caenorhabditis briggsae]
  Coding regions on vcDNA: vcDNA=SeqID_96001; Strand=+; Position=2-360
NKIRLLHRDKLKPCMWLNKHIQSHYRPLELPWTLCXRSIFQWNNETVNVWSHLLGFVWFVYLQWWALNESLPSVNAPIADYWVMGTAMLCSQLCMLLSSAYHIFGCHSPQRRKQWLRADL

SEQ ID NO: 169579 - protein, 335 aa, Heterodera glycines
  Homolog annotation: Hit_ID=CAE63207.1; Match level="QueryCoverage =100%, HitCoverage=10%, E-value=3e-59, Identity=38%"; Hit description= Hypothetical protein CBG07562 [Caenorhabditis briggsae]
  Gene Ontology: Mol. function=protein binding
  Coding regions on vcDNA: vcDNA=SeqID_96002; Strand=+; Position=3-1007
KLNLTMKRFNSWASQLENELEGWKDGCPCDFLPNMSPISDANDSSSLSSSSSWSSPLLHKYRLLIEPGNSPFEYVAPGVRAVRRLWNFLILQENLAPIFVRYSFAKAKDKIASSVTKGADLNSILNVIKLVHREHDPIVAFAANSIRPGVMVVSTGRELQELSIDRVLDEHERVVSRLQHYPSTSSFLLAQNWAELDISMQQIRRDPLRDNDDYQLLIPGSDGQPGKNIPTQTSAHLRKRLFSGVRRLEAHSSLPYYASGSSDGSVFLWEWGVEQPVFVARVAGQFAKVAKLAFAQNGARFAAVDGDGLLSIWQAQPGVPAKKPYFIQKCHTKFA

SEQ ID NO: 169580 - protein, 115 aa, Heterodera glycines; identical to SEQ ID NO: 165825
  Coding regions on vcDNA: vcDNA=SeqID_96003; Strand=-; Position=101-448

SEQ ID NO: 169581 - protein, 89 aa, Heterodera glycines; identical to SEQ ID NO: 168147
  misc_feature (46)..(46): Xaa can be any naturally occurring amino acid
  misc_feature (52)..(52): Xaa can be any naturally occurring amino acid
  Coding regions on vcDNA: vcDNA=SeqID_96004; Strand=-; Position=29-298

SEQ ID NO: 169582 - protein, 141 aa, Heterodera glycines
  Coding regions on vcDNA: vcDNA=SeqID_96005; Strand=+; Position=11-436
ALRFFDSMLVLRPPDGEQSVRQLMLLNISCLPINYGTNPRSTHYKRVTRNRLAEKGPDNGDECDTSFWTMMAYRHHFNDQNGTDCEEDAPMLVGAITVSNRNSNCSCCSSNKTDGVVQPQKQMFSVQIQTLACDYNDFSFL

SEQ ID NO: 169583 - protein, 142 aa, Heterodera glycines
  Homolog annotation: Hit_ID=CAE59194.1; Match level="QueryCoverage =82%, HitCoverage=15%, E-value=2e-14, Identity=37%"; Hit description =Hypothetical protein CBG02505 [Caenorhabditis briggsae]
  Coding regions on vcDNA: vcDNA=SeqID_96006; Strand=+; Position=100-525
MSSLEQLASPHNDFYESLFRQLNPSGSAEVDAASIAAFLKTAHGVSVAQLSQIWEIASELSGYKNRSALNKIGVYICLKLVAGIQHGFPLAPSVLDVPLSAVPQFEFLSFPTPPPLPPVPPPPSADSKSPSVSAELASGGGG

SEQ ID NO: 169584 - protein, 158 aa, Heterodera glycines
  misc_feature (82)..(82): Xaa can be any naturally occurring amino acid
  Homolog annotation: Hit_ID=CAB88203.1; Match level="QueryCoverage =100%, HitCoverage=91%, E-value=7e-69, Identity=60%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_96007; Strand=+; Position=1-473
MQETHIVLGIASVCSLLAIIATVVTLPSLYSEMSQMNSKVRDGVEAFRVNTDSAWTDLMDVQVVVTPPSKPRDNPFNSIFRXQPAPPCPPQNIPCPRCPAGPPGRPGGQGPPGQQGAPGQPGTPAQGGGPGTPGAPGPQGQPGQPGRPGAAGQPGQPG

SEQ ID NO: 169585 - protein, 97 aa, Heterodera glycines
  misc_feature (96)..(96): Xaa can be any naturally occurring amino acid
  Coding regions on vcDNA: vcDNA=SeqID_96008; Strand=+; Position=67-357
MVALSLIANSPVNYPPPPNASLFKILFYPPMQSVPLLAQLLATHFPLQIPSLSFSSCHFHLLFIPFLPFLCFFPLFCYFFCPPFLLPAQVEKINCXS

SEQ ID NO: 169586 - protein, 147 aa, Heterodera glycines; identical to SEQ ID NO: 163746
  Homolog annotation: Hit_ID=NP_500272.2; Match level="QueryCoverage =100%, HitCoverage=97%, E-value=9e-73, Identity=90%"; Hit description= ubiquitin conjugating enzyme (16.9 kD) (ubc-13) [Caenorhabditis elegans] gb|AAK93865.2| Ubiquitin conjug
  Gene Ontology: Mol. function=ubiquitin conjugating enzyme activity; Cellular component=cytoplasm; Biological process=flight behavior
  Coding regions on vcDNA: vcDNA=SeqID_96009; Strand=+; Position=2-445

SEQ ID NO: 169587 - protein, 157 aa, Heterodera glycines
  Coding regions on vcDNA: vcDNA=SeqID_96010; Strand=+; Position=3-473
KMPNLLQVLFGPVVYRPYQPNLLESGGNKLFSIGAGAYNTCVVLSPILVPYIAFSWTHSHHFSFLRFVLVFYAIAFSFRTIGRLTNVDYVRFIKLLGTVRKSPQNVTLLDTLKDYDFQVYAAPADFKASPGRTAKWHPPRERLPDLNPPLNFLRQAI

SEQ ID NO: 169588 - protein, 158 aa, Heterodera glycines
  misc_feature (54)..(54): Xaa can be any naturally occurring amino acid
  Homolog annotation: Hit_ID=AAC47437.1; Match level="QueryCoverage =100%, HitCoverage=76%, E-value=8e-54, Identity=47%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_96011; Strand=+; Position=2-476
QHNAKDIWSEVSQLKGMPLLVAGNRTARSAYGSCQECCSGGAQGQPGQPGQPGXPPPCTPCPGGQPGNNGPPGPPGAPGAPCQPGTGGGQPQPGEPGPPGPNGQPGQPGQPGAPGQPGAAGQPGPKGPPGGPGQPGNGGAPGQPGQPGQPGNPGERGI

SEQ ID NO: 169589 - protein, 84 aa, Heterodera glycines; identical to SEQ ID NO: 152292
  Coding regions on vcDNA: vcDNA=SeqID_96012; Strand=-; Position=2-253

SEQ ID NO: 169590 - protein, 197 aa, Heterodera glycines
  Homolog annotation: Hit_ID=NP_495386.1; Match level="QueryCoverage =96%, HitCoverage=34%, E-value=2e-67, Identity=63%"; Hit description =seven transmembrane helix receptor like (2H65) [Caenorhabditis elegans]
  Gene Ontology: Mol. function=protein tyrosine phosphatase activity; Cellular component=transcription factor complex; Biological process =cell cycle
  Coding regions on vcDNA: vcDNA=SeqID_96013; Strand=+; Position=46-636
MMNIRSNGKIRFAVSCSSNMNRSMEAHFFLQKRGFNVQSFGSGNYVKLPGPSVDKPNIYEFDSTTYEHILQDLKQKDSKLYTQNGLLNMLDRNRRIKKCPQKFQNYKEKFCVIICLEERVYDQIVDFLQTRESTTGESVHVINFDIQDNHEEATIGALHVVELCKKLEDCEDLDNEIDEALSEFEANNPERNLLHTI

SEQ ID NO: 169591 - protein, 75 aa, Heterodera glycines
  Coding regions on vcDNA: vcDNA=SeqID_96014; Strand=+; Position=3-227
NEQIDIKPKIEVRKSHEEKKKKRRHYSSEEEEEGTEEEEKKPEPIDQEQLLVNMREEHNLKFKTGILIGLRADEH

SEQ ID NO: 169592 - protein, 338 aa, Heterodera glycines
  Homolog annotation: Hit_ID=CAE62153.1; Match level="QueryCoverage =99%, HitCoverage=62%, E-value=1e-149, Identity=72%"; Hit description= Hypothetical protein CBG06199 [Caenorhabditis briggsae]
  Gene Ontology: Cellular component=mitochondrion; Biological process =glutamate catabolism
  Coding regions on vcDNA: vcDNA=SeqID_96015; Strand=+; Position=2-1018
VPAPDMGTGEREMACIADTYAPTVGHTDKEASACVTGKPIVAGGIHGRVSTTGRGLWKGLAVFINDEKFMTKLGLTTGFKGNTFIVQRFSNVGLHSHRYLHRDGAICIGVQEYDCAIYNPNGIHPKELEDWKIANGSIRGFPGAKAFEPFTDLIFEKCDILVPAACEKAIHLGNAHRIQAKVIAEAANGPTTPAADAVLMNRGDCLIVPDMFINSGGVTVSYFEWLKNLNHVSFGRLTFKYERDSNYHLLASVQKSLERTFDRAVPVDPSEEFQLRIAGASEKDIVHSGLEYTMNRSAKQIIATTNKYNLGLDLRTAAYANAIEKIYQTYETSGFTFA

SEQ ID NO: 169593 - protein, 182 aa, Heterodera glycines
  Homolog annotation: Hit_ID=XP_312315.1; Match level="QueryCoverage =65%, HitCoverage=11%, E-value=5e-10, Identity=33%"; Hit description =ENSANGP00000010577 [Anopheles gambiae]
  Coding regions on vcDNA: vcDNA=SeqID_96016; Strand=+; Position=3-548
SSPRWRPLSNSGSPGLQVSGTRPTLGTSQVKSVRKELKMHLLRMLKHPGTFTLHNLHPRMKQLLIELGASQSEIQRAMPAINEIDEALKKRLAAATAVAAGTARQTTTEPKRHRKEPQQHEQEDLDLRDIKRIKLDEDEYDDGIIDLYKQLDNPDSANAATQKAIDITTNFVLERLSIHVVT

SEQ ID NO: 169594 - protein, 80 aa, Heterodera glycines
  Coding regions on vcDNA: vcDNA=SeqID_96017; Strand=-; Position=36-278
RFTSLIFKFAIRIINFLVQLDLLLLMRFLRLLLKFNSEGDTGAECEWISIIGSDRRGTEADLTSLPFPIKRPEVLTELSS

SEQ ID NO: 169595 - protein, 170 aa, Heterodera glycines
  Homolog annotation: Hit_ID=NP_501646.1; Match level="QueryCoverage =97%, HitCoverage=16%, E-value=6e-27, Identity=38%"; Hit description =putative protein, with at least 6 transmembrane domains, of eukaryotic origin (4K108) [Caenorhabditis ele
  Coding regions on vcDNA: vcDNA=SeqID_96018; Strand=+; Position=1-510
HGYTAGLLTLPLPALVFLWGTLASPRPSKLFWIVMIIYTEFEIVAKFAFQFGFWPWNGDTVGNNKVYKTEYVFGVQRIQGFAGKDVALLIALFFHRYMLRKFGLWRDASSDRLINEMPKKRMDNGSSSSSSAEKSPQKSTQSTVVPSSSGENFESVAKAQREQNSDDIEK

SEQ ID NO: 169596 - protein, 197 aa, Heterodera glycines
  Homolog annotation: Hit_ID=CAE70938.1; Match level="QueryCoverage =81%, HitCoverage=38%, E-value=2e-13, Identity=31%"; Hit description =Hypothetical protein CBG17741 [Caenorhabditis briggsae]
  Coding regions on vcDNA: vcDNA=SeqID_96019; Strand=+; Position=32-625
FPLSIEQTIAHPLRVSAAHLQPTKDKMMTRRAFRCSECATMLYRDQLSPNDVKPLLQSFALDHFPEIHISRPVKLGPGQNSAIFLTLTNNSSGPIDISLTGKRLEEEENCVNNSDFSLQLVLSNRGSTDEQPKMAHQQSDSRIINISQHRVGICAECVPSADSIDHYALFSLSFSHTSSDLPEKKLKSDVIVSLKQS

SEQ ID NO: 169597 - protein, 126 aa, Heterodera glycines; identical to SEQ ID NO: 162713
  Homolog annotation: Hit_ID=NP_500737.1; Match level="QueryCoverage =86%, HitCoverage=28%, E-value=2e-22, Identity=44%"; Hit description =peptide chain release factor (43.5 kD) (4F953) [Caenorhabditis elegans] gb|AAB94190.1| Hypothetical prote
  Gene Ontology: Cellular component=mitochondrion
  Coding regions on vcDNA: vcDNA=SeqID_96020; Strand=+; Position=1-381

SEQ ID NO: 169598 - protein, 101 aa, Heterodera glycines; identical to SEQ ID NO: 165812
  Homolog annotation: Hit_ID=CAE74212.1; Match level="QueryCoverage =86%, HitCoverage=43%, E-value=2e-22, Identity=58%"; Hit description =Hypothetical protein CBG21894 [Caenorhabditis briggsae]
  Coding regions on vcDNA: vcDNA=SeqID_96021; Strand=+; Position=1-306

SEQ ID NO: 169599 - protein, 159 aa, Heterodera glycines
  misc_feature (102)..(102): Xaa can be any naturally occurring amino acid
  Homolog annotation: Hit_ID=NP_505967.1; Match level="QueryCoverage =86%, HitCoverage=71%, E-value=2e-42, Identity=62%"; Hit description =stem cell derived neuronal survival protein like (5M244) [Caenorhabditis elegans] emb|CAA96655.1| Hypothe
  Coding regions on vcDNA: vcDNA=SeqID_96022; Strand=+; Position=1-475
RHEAQFICLFVFLFSKNYLANSHQLPSFPGQQEPLQGHHQQHAQQQQQQQQVNAGAEHQQQHAQFGGEQVKDEGHIKEHLEGKVDPTAHMTPEQLQFHYFNXHDLDKNGKLDGIELIKAITHFHQENASPGHQGASIPPPLPNENELENMIDSILREDD

SEQ ID NO: 169600 - protein, 139 aa, Heterodera glycines
  Coding regions on vcDNA: vcDNA=SeqID_96023; Strand=+; Position=5-424
MRSEVPAPHALGRSRSLADVFRSNSRYAESQFSPTVVPIGMPSKPISVHRPYLTYSAYWPYRYHRNFNTYDNQITDSFYWHYPFRLWTSYKHNWYQYDSPYYYRRYHDNYNIFYNTELMSYGNRSKLMENLYQGTPITQ

SEQ ID NO: 169601 - protein, 145 aa, Heterodera glycines
  Coding regions on vcDNA: vcDNA=SeqID_96024; Strand=+; Position=1-438
EIEDMEEFWKQAQQIQTDNHELSERVSSLTREHNTLRTEHERILVDHNTLRTEHERILVDHNTLRTEYERILQRQLDDFHYWILCFAFFIPPLSILATARNNGLSFPVTVLSALAATNFCAFLWIPGILFALAFYFGLRKNAKKE

SEQ ID NO: 169602 - protein, 139 aa, Heterodera glycines
  Coding regions on vcDNA: vcDNA=SeqID_96025; Strand=+; Position=2-421
EFWKQTQQIQTDNHELSERVSSLTRENNTLRVDHNTLRVDHNTLRTEHERILVDHNTLRTEYERILQRQLDDFHYWILCFAFFIPPLSILATARNNGLSFPVTVLSALAATIFCAFLWIPGILFALAFYFGLRNNAKKE

SEQ ID NO: 169603 - protein, 156 aa, Heterodera glycines
  misc_feature (80)..(80): Xaa can be any naturally occurring amino acid
  Homolog annotation: Hit_ID=CAE58471.1; Match level="QueryCoverage =97%, HitCoverage=42%, E-value=1e-13, Identity=30%"; Hit description =Hypothetical protein CBG01611 [Caenorhabditis briggsae]
  Coding regions on vcDNA: vcDNA=SeqID_96026; Strand=+; Position=13-480
MSDQQQSKIVGTVGAVCALGTVAVLLLLLVQRKKKQRQCNTEEYVRAGHVEQLYIYPMKSCRGNKVDWLDCGERGCAHGXQRDRHFLVVDSARQNQMLTGRIYPKMLLISVHVEQGVLRVDFPNRSSPVEVNLKEVEERNVVLRAKLFSDLQTDGL

SEQ ID NO: 169604 - protein, 114 aa, Heterodera glycines; identical to SEQ ID NO: 163006
  Homolog annotation: Hit_ID=CAE63460.1; Match level="QueryCoverage =82%, HitCoverage=84%, E-value=2e-17, Identity=50%"; Hit description =Hypothetical protein CBG07924 [Caenorhabditis briggsae]
  Coding regions on vcDNA: vcDNA=SeqID_96027; Strand=+; Position=91-435

SEQ ID NO: 169605 - protein, 172 aa, Heterodera glycines
  Homolog annotation: Hit_ID=CAE64583.1; Match level="QueryCoverage =93%, HitCoverage=39%, E-value=2e-48, Identity=58%"; Hit description =Hypothetical protein CBG09336 [Caenorhabditis briggsae]
  Gene Ontology: Mol. function=glycine dehydrogenase (decarboxylating) activity; Cellular component=mitochondrion; Biological process =glycine metabolism
  Coding regions on vcDNA: vcDNA=SeqID_96028; Strand=+; Position=1-519
LSSKVARPKLAGLGARDVLRTEAGLCLFGNEIDERTTPVEAGIAFVIAKRRRQTLGFPGAERIIRQLEKKDFVKKRVGLASTKAGRAARNKMPIANPTDGSSVGFVTSGCPSPTLGKNIGMGYVDKAYAKVGNILTVEAGRDRMIEVEVVKMPFVKSAYYLKPTSVNEDKKK

SEQ ID NO: 169606 - protein, 197 aa, Heterodera glycines
  Homolog annotation: Hit_ID=CAE74460.1; Match level="QueryCoverage =76%, HitCoverage=27%, E-value=6e-23, Identity=41%"; Hit description =Hypothetical protein CBG22204 [Caenorhabditis briggsae]
  Gene Ontology: Mol. function=histone-specific chaperone activity; Cellular component=chromatin assembly complex; Biological process =DNA replication dependent nucleosome assembly
  Coding regions on vcDNA: vcDNA=SeqID_96029; Strand=+; Position=3-593
FLDDKEKENGTKNCEAEAKKVELEDERKQKEVEQNNAGKRSIAVPQNQLSVEFLANIEGHRGTTNIVRFSPNGTYIASGDADGFLFVWKLEQEVLECEVQMLEEPATVRQRDADPEMDIPPNKENWARAFRSPIRHDGDVTGISWSPDSQMLASVSMDDSGAVHRAENGKRVWAIRNFRHFANGIAWDPCGKYIITM

SEQ ID NO: 169607 - protein, 148 aa, Heterodera glycines
  Homolog annotation: Hit_ID=CAG12591.1; Match level="QueryCoverage =94%, HitCoverage=93%, E-value=9e-23, Identity=44%"; Hit description =unnamed protein product [Tetraodon nigroviridis]
  Gene Ontology: Biological process=cotranslational membrane targeting
  Coding regions on vcDNA: vcDNA=SeqID_96030; Strand=+; Position=27-473
MEVKLKPYSDPSRWVAIYPLYIDASKSLAQGRRIAKAKAVNNPTCQEIFDVLNHAGLRCELEQKKTHPRAQSRGAANPKQQQQEEGRIRVQLKGDDGENVGEGAAQPKFMTRQQMMEYAAEMVPKLKTRQQQTQVEQNDATGKQKKRK

SEQ ID NO: 169608 - protein, 148 aa, Heterodera glycines
  Coding regions on vcDNA: vcDNA=SeqID_96031; Strand=+; Position=43-486
MSLLFVVSMFVDGCAILWSYWDRFKKPKKKIFISADCWLCVFDLLAPSQLGLGISMISHRFDYYVDEHFKTRKWTLKSIRIRRKIGKNGTKQMAIVNYDWKPLPIPKIRMPRKVIGFKSIRILFIDRNAIAFLRHFCQIFAVCPINLS

SEQ ID NO: 169609 - protein, 228 aa, Heterodera glycines
  Coding regions on vcDNA: vcDNA=SeqID_96032; Strand=+; Position=14-697
MENCLSNGNDSCRSGSFLLEMKPSTDLASLFVSLPGPVSNEGKAVDEPLGIMRVDNQSLEIAFDVQDIAEQTGCQSADFSSSMFFQKFGAKFVDIMLEPTTLCSPSWADAQQRLIMCKVRAEADCVTFAPKTIGLLEEELAQRCLLREYVERIEHNRTFHVNCRRCGHLIHSHSKGDFVFGVFPNDDWLETAPQMDYFCALSSDCCGAHLEMSSVQPRNSGEGILGFS

SEQ ID NO: 169610 - protein, 250 aa, Heterodera glycines
  misc_feature (84)..(84): Xaa can be any naturally occurring amino acid
  Homolog annotation: Hit_ID=NP_503353.1; Match level="QueryCoverage =84%, HitCoverage=39%, E-value=2e-18, Identity=28%"; Hit description =HpaII tiny fragments locus 9c (5B389) [Caenorhabditis elegans]
  Coding regions on vcDNA: vcDNA=SeqID_96033; Strand=+; Position=1-750
KAGAPRGGGRSPTSGSPGLQEFGTRKRRLLLHWVTESTIEISNVSPFAGTAPSKKFIQGHLANISFRKLKFAGRIGCITMDSEXCEDRAIHLLDNAIFKKNCLSVTKAIDLPKCPKTVSVAQTDEAEKSCKMLVTPLFDIPYEEQLKIKFDHSKKVLELLQKKLTQAHATNSLIAKESLPKNVLPSPLIEQYRNKCEFSVGYSSGDNRSAVVGFMSGKMANRQSNVLAPDECSNLTRNTRSIVRHFEAFV

SEQ ID NO: 169611 - protein, 157 aa, Heterodera glycines
  Homolog annotation: Hit_ID=NP_509390.2; Match level="QueryCoverage =89%, HitCoverage=66%, E-value=2e-40, Identity=49%"; Hit description =putative protein family member, with at least 3 transmembrane domains (XI852) [Caenorhabditis elegans]
  Coding regions on vcDNA: vcDNA=SeqID_96034; Strand=+; Position=3-473
IANCPFLFDRFFYFRRFSSPPKMGEVRFHSDYVSSNRGITKIIQIVLGFVVCSVLCSNWYGGYSCFGEGRLGYVSGLNFVCLMINIILFLLNLFNIRPLKLEQLYNVAAALLLLVGIVLLLWYMIQYSYWNIWMIIAAVCVLIIFLLFQWDFKGNRT

SEQ ID NO: 169612 - protein, 170 aa, Heterodera glycines
  Coding regions on vcDNA: vcDNA=SeqID_96035; Strand=+; Position=41-550
WIPRAAGIRHEAATKSPIPGVIRRTFVLPSCKGHKQQQQVSIGDEKDGKTTTLLVPMFSQELASLLAPEQSTDFSIRLQSKSNNCISLRVQVCCTLPSKSENEGQPLEEPAELVQHFPIRCVDPFEPKIAIFCENGGKAQCLVFGQKFRVQLQLKCNGRVAVHNVHWKLN

SEQ ID NO: 169613 - protein, 111 aa, Heterodera glycines; identical to SEQ ID NO: 163001
  Homolog annotation: Hit_ID=NP_492071.1; Match level="QueryCoverage =93%, HitCoverage=94%, E-value=6e-18, Identity=40%"; Hit description =putative membrane protein family member (1H895) [Caenorhabditis elegans] emb|CAA95822.1| Hypothetical pro
  Coding regions on vcDNA: vcDNA=SeqID_96036; Strand=+; Position=60-395

SEQ ID NO: 169614 - protein, 158 aa, Heterodera glycines
  Homolog annotation: Hit_ID=CAE68444.1; Match level="QueryCoverage =98%, HitCoverage=54%, E-value=3e-63, Identity=69%"; Hit description =Hypothetical protein CBG14232 [Caenorhabditis briggsae]
  Gene Ontology: Mol. function=glycogenin glucosyltransferase activity; Cellular component=soluble fraction; Biological process=glycogen biosynthesis
  Coding regions on vcDNA: vcDNA=SeqID_96037; Strand=+; Position=1-474
LDSADAENLALINRPDLGVTFTKLHCWRLTQYSKCVFLDADTFVVKNCDELFERPEFSAAPDVGWPDIFNTGVFVFVPSEQTYRNLLDFALVYGSFDGGDQGLLNAYFSTWRESDATHRLPFTYNVTTVAIYGYAAALKRFAPNIKIIHFLGKQKPWA

SEQ ID NO: 169615 - protein, 157 aa, Heterodera glycines
  Homolog annotation: Hit_ID=NP_492588.1; Match level="QueryCoverage =88%, HitCoverage=26%, E-value=4e-31, Identity=55%"; Hit description =protein phosphatase 1 regulatory, GEI-4(Four) Interacting protein GFI-2 (53.7 kD) (gfi-2) [Caenorhabditis
  Coding regions on vcDNA: vcDNA=SeqID_96038; Strand=+; Position=3-473
ARRKRIGHFGVRDSRRQSRKRKKFESPQAVPPAANTDFIQTARGAIRRQSLRDRSGMTLARLDSQREGSDLIRSWSKEDVSNEEMSAHHFGNGGPSTSHQPTANQQRRDSPPKRMQKQSQQKQKQMSPDEWFKKLEAESGGLRDEEEEQAEKDVLKG

SEQ ID NO: 169616 - protein, 190 aa, Heterodera glycines
  Coding regions on vcDNA: vcDNA=SeqID_96039; Strand=+; Position=16-588
NSILDQFPSFIAAVIKKEEAKKTKMIGMMNNAGMDGPAEFFAGRRDLCELLVPASSLAAVDGQAQPHAPPPKVFEPTQQKKLSYTGSGRRLVDGKPEVNETPEEMWRKAMLRATCTRAVKEMLGEKRRKSSKLRQLISSQSGSIRNFFGTAKNLRHRTTGANQPQQQVEAGGKVISSRTEGPGKPDRMII

SEQ ID NO: 169617 - protein, 311 aa, Heterodera glycines
  Homolog annotation: Hit_ID=NP_494848.3; Match level="QueryCoverage =97%, HitCoverage=58%, E-value=5e-63, Identity=41%"; Hit description =AMP-dependent synthetase and ligase family member (55.7 kD) (2F35) [Caenorhabditis elegans] gb|AAC46810.4
  Coding regions on vcDNA: vcDNA=SeqID_96040; Strand=+; Position=26-958
MLFQRQKLPKICATLFPKCQIRRSSNFVELAGFTASTDSKQYAAKKLLLLKNGSSRSYNDVNVAAGRFAALLNKKYGIQKGDTVLCRTSKNVDALALYLAVLRLGAIYVPLNPTYTKRETEHFVNDAKPKVMVSLNASEDASFTQSGFDVKHVLCEKRLAEEALKQEPSCEVEPAEKDDVACILYTSGTTGRPKGAMVTHGGLVANAETCTDIWHFSENDINLHVLPFYHIHGLFISFNCTLMSKSSCIFLPKFDVDETIAYLPKSTAMMGVPTFYARMVEHAGLNRAAGKNMRVFISGSAQLTPQVVEKF

SEQ ID NO: 169618 - protein, 101 aa, Heterodera glycines
  Homolog annotation: Hit_ID=AAP94888.1; Match level="QueryCoverage =87%, HitCoverage=24%, E-value=2e-10, Identity=40%"; Hit description =P34 [Ascaris suum]
  Coding regions on vcDNA: vcDNA=SeqID_96041; Strand=+; Position=32-337
MKAIGEAKIKRQKKQPEAVRRQAIADLLSGCPNEFGQVLKYIDDMKYTDKPDYDWIIATLRSSLSNAGVQEFPYDWETGKRNAAPGAGGGGGGGGGDSYFN

SEQ ID NO: 169619 - protein, 159 aa, Heterodera glycines
  Coding regions on vcDNA: vcDNA=SeqID_96042; Strand=+; Position=3-479
NQSPPLAMAPSQMVKSSQSHTDGFCQLLHHQSRPPCASSSSSASSSGYASMVNSIVNPCANRLAGIDEEETAIGGGGSSSRRQSTTIGESGENEGEEKETAVQEDWQAVAEEEQKQQQKGAIGAFASPEGTNCCSSKNPLMRDDFRQLPSSNGLVEALS

SEQ ID NO: 169620 - protein, 126 aa, Heterodera glycines
  Coding regions on vcDNA: vcDNA=SeqID_96043; Strand=+; Position=64-444
DHAHEGLPRGPQEEEDGAGQPTSNIPSTSKQQKDKETSGDSKIALPPPKLAIIVEATESAPRGVICPTLPPICCAMTLDWRQCEQHRIGEGGVYVPFPGGEQSTCSDRQNQSVFTNCFGNRRTGKF

SEQ ID NO: 169621 - protein, 208 aa, Heterodera glycines; identical to SEQ ID NO: 163740
  misc_feature (198)..(198): Xaa can be any naturally occurring amino acid
  Homolog annotation: Hit_ID=NP_004090.4; Match level="QueryCoverage =92%, HitCoverage=67%, E-value=2e-61, Identity=58%"; Hit description =stomatin isoform a [Homo sapiens] emb|CAH70728.1| stomatin [Homo sapiens] emb|CAH72707.1| OTTHUMP00000064
  Gene Ontology: Mol. function=protein binding; Cellular component =lipid raft; Biological process=signal transduction
  Coding regions on vcDNA: vcDNA=SeqID_96044; Strand=+; Position=1-624

SEQ ID NO: 169622 - protein, 77 aa, Heterodera glycines
  Coding regions on vcDNA: vcDNA=SeqID_96045; Strand=+; Position=3-236
SITLPGREDNDMLIHNLAIHGIAAAEGSACSSGSAIASPVIAALQGEHNQAIRFSFSKYTTHEEIAKTVEVLRHLAL

SEQ ID NO: 169623 - protein, 227 aa, Heterodera glycines; identical to SEQ ID NO: 163990
  misc_feature (221)..(221): Xaa can be any naturally occurring amino acid
  Homolog annotation: Hit_ID=CAE69821.1; Match level="QueryCoverage =78%, HitCoverage=56%, E-value=8e-33, Identity=42%"; Hit description =Hypothetical protein CBG16139 [Caenorhabditis briggsae]
  Gene Ontology: Mol. function=enoyl-CoA hydratase activity; Cellular component=mitochondrion; Biological process=growth
  Coding regions on vcDNA: vcDNA=SeqID_96046; Strand=+; Position=110-790

SEQ ID NO: 169624 - protein, 167 aa, Heterodera glycines
  Homolog annotation: Hit_ID=CAB88204.1; Match level="QueryCoverage =100%, HitCoverage=92%, E-value=7e-89, Identity=66%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_96047; Strand=+; Position=4-504
MQETQIIVGVASLCSILAILATVVVVPSLYSEINEIATKVHDGVQAFRVDTDSAWTDLMDLQITVTPPSKPRQNPFSSIFRQKRQLPGHCQCAGVQQPNCPPGPPGPAGSPGQPGQPGQPGGPGQPGVPGQQGPPCPVYTPPCQHCPAGPPGQPGSQGPQGRPGAPG

SEQ ID NO: 169625 - protein, 158 aa, Heterodera glycines
  Coding regions on vcDNA: vcDNA=SeqID_96048; Strand=+; Position=3-476
KLTRVCSWLGSELNYDPAKIMLYKNVLHGDKPGMWIPHQQLLELQVSQMLNLNTGSYDPRFQRIFKFFYAKLPLPMVDFDNHAHVLLHLMNEKFQLTEMSIFVDKNASVQTLLDEARKEFRFSSMGTKTLRLVQASADGTFRVYQVLKNDILYKDIQL

SEQ ID NO: 169626 - protein, 140 aa, Heterodera glycines
  Homolog annotation: Hit_ID=NP_741756.1; Match level="QueryCoverage =95%, HitCoverage=36%, E-value=5e-41, Identity=60%"; Hit description =endophilin B2 (40.8 kD) (XE420) [Caenorhabditis elegans] gb|AAB52640.1| Endophilin-related protein protei
  Coding regions on vcDNA: vcDNA=SeqID_96049; Strand=+; Position=116-535
MDFNLKRLAGEASGMFSRAKQLTEEKLLNAEKTELDPHFEQLLAKADKTEEQSKKLLSAMEAYLQPNPALRMGDLFYEKMEITSPAPNRSNTLEYLSEAMQEAAQSFGTETPFGGALQKIAQTEAKLGAAEREMVQTTAG

SEQ ID NO: 169627 - protein, 218 aa, Heterodera glycines
  Homolog annotation: Hit_ID=XP_415012.1; Match level="QueryCoverage =99%, HitCoverage=44%, E-value=1e-36, Identity=40%"; Hit description =PREDICTED: similar to brain-selective and closely mapped on the counter allele of CMAP in cystatin cluste
  Coding regions on vcDNA: vcDNA=SeqID_96050; Strand=+; Position=1-654
HLPPPPALTGLLTVNKPKVLEKLLEGQVLGPESAVIENGKRKTIPICGRPLGIRRFNSQQFIVADAVLGLLLINFEEETKEVLLPSITVVDKKRLGFPDDLDIVDNDTILFTDLSAKYGYSDCDLAFFEHIRDGRLLEYKVSTGQLRVLMDGLAVANGVQLHPDKNSVLVCETAMARIHRYYFAGPKKGMQQIFVDNLPGFPDNIRISRSADSFYVAL

SEQ ID NO: 169628 - protein, 134 aa, Heterodera glycines
  misc_feature (49)..(49): Xaa can be any naturally occurring amino acid
  misc_feature (51)..(51): Xaa can be any naturally occurring amino acid
  misc_feature (61)..(61): Xaa can be any naturally occurring amino acid
  misc_feature (68)..(68): Xaa can be any naturally occurring amino acid
  Homolog annotation: Hit_ID=CAB88203.1; Match level="QueryCoverage =100%, HitCoverage=42%, E-value=1e-31, Identity=58%"; Hit description= putative cuticular collagen [Globodera pallida]
  Coding regions on vcDNA: vcDNA=SeqID_96051; Strand=+; Position=3-404
ETHIVLGIASVCSLLAIIATVVTLPSLYSEMSQMNSKVRDGVEAFRVNXPXSAWTDLMDVXVVVTPPXEAPGDKPPSNFIFRAQKQLPGTCQCLASTANFPLVARPSAPWNPTAGTQKPETESLQNLPLRPKSP

SEQ ID NO: 169629 - protein, 75 aa, Heterodera glycines
  Coding regions on vcDNA: vcDNA=SeqID_96052; Strand=+; Position=3-230
LLDRSVIRFHGLIPSKQRNPFSAESALTSFVQRSASVSNRQSPIQKKRRPIKSCAGVSCPPTQPNGTPKAADNGI

SEQ ID NO: 169630 - protein, 166 aa, Heterodera glycines
  Homolog annotation: Hit_ID=AAH44091.1; Match level="QueryCoverage =100%, HitCoverage=29%, E-value=2e-54, Identity=58%"; Hit description= Cbs-prov protein [Xenopus laevis]
  Gene Ontology: Mol. function=cystathione beta-synthase activity; Cellular component=cytoplasm; Biological process=cysteine metabolism
  Coding regions on vcDNA: vcDNA=SeqID_96053; Strand=+; Position=2-499
NPLVHYEGTAEEIIWACDGKLDAMVVGAGTGGTMTGIANKMRQKLPNCKIIAIDPEGSILANPTNRQKHAYEIEGIGYHFVPYTTDRNLVDEWIKTNDANAFRTARRLISEEGLLCGGSSGANVWAAMEVAKTMGRGKRVVTILPDGIPNYMSKFIDDEWMIVKGF

SEQ ID NO: 169631 - protein, 137 aa, Heterodera glycines
  Homolog annotation: Hit_ID=CAA12057.1; Match level="QueryCoverage =84%, HitCoverage=49%, E-value=1e-42, Identity=73%"; Hit description =adenylate kinase [Piromyces sp. E2]
  Gene Ontology: Mol. function=adenylate kinase activity; Cellular component=mitochondrial intermembrane space; Biological process=cell proliferation
  Coding regions on vcDNA: vcDNA=SeqID_96054; Strand=+; Position=64-474
MAPTATSSQEYRQQTYNLPRAIRMVIMGPPGAGKGTQAPAIRSLFGACHLATGDMLRAAVSAGTPLGKEAKKVMDAGGLVSDEIVVGLIRENLDTNPDCRNGFILDGFPRTVTQAEKLDDMLAAKHQALSHAVELKI

SEQ ID NO: 169632 - protein, 268 aa, Heterodera glycines
  Homolog annotation: Hit_ID=CAE59883.1; Match level="QueryCoverage =84%, HitCoverage=5%, E-value=2e-32, Identity=38%"; Hit description =Hypothetical protein CBG03363 [Caenorhabditis briggsae]
  Gene Ontology: Cellular component=ubiquitin ligase complex; Biological process=protein modification
  Coding regions on vcDNA: vcDNA=SeqID_96055; Strand=+; Position=60-863
VWRRTTKLVARVCKEVSGRESVPGKFLKSLETFQYLCNQCAKRWRNSRKKAQLTKKKDDTEKEGAEEHQQATTSKPQADTHAKEESDEATLVRNMVDELAPLWEELSNCLSLLEKAEDSQHAVLCLQNAAEAFFLSYSLVIPQTAQLAPSALPETAPTGGSSPQLASSSAGGNSGEDELGRYQKEMFTFAEKHRSVLNQILRGNTQNLEGSAFAILTHFPKLLDFDVKTKYFHKELKKMDERSRYRHEDVAIRVRRSHLFGDSFRELY

SEQ ID NO: 169633 - protein, 148 aa, Heterodera glycines
  Coding regions on vcDNA: vcDNA=SeqID_96056; Strand=+; Position=2-445
MHQGIPNVPTVSNNGTSFGRVAPPGISDTISTTTQFTITATNLPITSFVTTQDPNVRSEFEKADAPEILKIFIPPKPPAVPQEAKKIFEDLCAGGKCLVQKPEFIQQKAAVEKESEQIELKLNPGKSAEQVKREVKVRMAKTQQLKKA

SEQ ID NO: 169634 - protein, 181 aa, Heterodera glycines
  Homolog annotation: Hit_ID=AAL78214.1; Match level="QueryCoverage =85%, HitCoverage=78%, E-value=5e-11, Identity=29%"; Hit description =putative esophageal gland cell protein Hgg-20 [Heterodera glycines]
  Coding regions on vcDNA: vcDNA=SeqID_96057; Strand=+; Position=88-630
MNRRWICGDVWMDILPSFDRPQLGLKMALLSDRFDVLVDKHFDRKSELTIWRRIRIDKDKGPKAKLSVLIDDKCVAFPLPDHSLPIKIRFKELQIDYIGHSVITFLSSNQQIWDRKGTNLDLFIFATDHNNIQSIWDVLAREIWPIFATNIRHLAFRNGDHLDNLRSYTSPTILTDLDQLN

SEQ ID NO: 169635 - protein, 243 aa, Heterodera glycines; identical to SEQ ID NO: 163415
  Homolog annotation: Hit_ID=CAB88203.1; Match level="QueryCoverage =100%, HitCoverage=80%, E-value=1e-100, Identity=67%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_96058; Strand=+; Position=66-794

SEQ ID NO: 169636 - protein, 318 aa, Heterodera glycines; identical to SEQ ID NO: 164012
  Homolog annotation: Hit_ID=NP_499001.1; Match level="QueryCoverage =92%, HitCoverage=93%, E-value=3e-56, Identity=41%"; Hit description =putative cytoplasmic protein of ancient origin (3K134) [Caenorhabditis elegans] emb|CAA78469.2| Hypotheti
  Coding regions on vcDNA: vcDNA=SeqID_96059; Strand=+; Position=59-1015

SEQ ID NO: 169637 - protein, 153 aa, Heterodera glycines
  Coding regions on vcDNA: vcDNA=SeqID_96060; Strand=+; Position=17-475
MEVDHQSLDSICENILSISRHLDLPLADNLDNAHLSLFKTKLTEFAKESKKQKAIPSLLLPSNLSLNDNEWAKFGQYVDLMNADYAERALLLKRRAEVTIDSFLWSDRVKQIEDKIRQVLEVGGFTNVHFDPVHADDVLAANLDLLYVTKTSD

SEQ ID NO: 169638 - protein, 158 aa, Heterodera glycines
  Homolog annotation: Hit_ID=CAA25063.1; Match level="QueryCoverage =93%, HitCoverage=22%, E-value=2e-70, Identity=84%"; Hit description =unnamed protein product [Feline sarcoma virus] pir||TVMVRR protein -tyrosine kinase (EC 2.7.1.112) fgr - fe
  Gene Ontology: Cellular component=actin filament; Biological process =cytoskeleton organization and biogenesis
  Coding regions on vcDNA: vcDNA=SeqID_96061; Strand=+; Position=2-475
LLLVLCPFARALWPPHSQPHPPPSTMSDEISALVIDNGSGMCKAGFAGDDAPRSVFPSIVGRPRHHNVMAGMGQKDSYVGDEAQSKRGILTLKYPIEHGIVNNWDDMEKIWHHTFYNELRVAPEEHPVLLTEAPLNPKVNREKMTQIMFETFNTPAFY

SEQ ID NO: 169639 - protein, 210 aa, Heterodera glycines; identical to SEQ ID NO: 162600
  Coding regions on vcDNA: vcDNA=SeqID_96062; Strand=+; Position=3-635

SEQ ID NO: 169640 - protein, 90 aa, Heterodera glycines
  Coding regions on vcDNA: vcDNA=SeqID_96063; Strand=+; Position=1-273
RRSVLRGRHTKTLKRHEQSKCNRRRSGRRTVTPPPRPSPHFPVSLLFLFFVVSPIHPNFVPKKLPFVPSFDEKRSVITIRNCKRSANKKG

SEQ ID NO: 169641 - protein, 104 aa, Heterodera glycines
  Coding regions on vcDNA: vcDNA=SeqID_96064; Strand=+; Position=74-388
APTWDPAPPSLHRRPAPRKPLHRQESRAPTWDPAPPSLHRRPAPRKPLHRQESRAPTWEPRPRTSRQRRRSPRIRAPTCEKMQQRPADGWTKPEERATCQKMQR

SEQ ID NO: 169642 - protein, 104 aa, Heterodera glycines
  Coding regions on vcDNA: vcDNA=SeqID_96065; Strand=+; Position=98-412
APTWDPAPPSLHRRPAPRKPLHRQESRAPTWDPAPPSLHRRPAPRKPLHRQESRAPTWEPRPRTSHQRRRSPRIRAPTCEKMQQRPADGWTKPEERATCQKMQS

SEQ ID NO: 169643 - protein, 178 aa, Heterodera glycines
  misc_feature (148)..(148): Xaa can be any naturally occurring amino acid
  Homolog annotation: Hit_ID=EAA00341.2; Match level="QueryCoverage =93%, HitCoverage=95%, E-value=3e-55, Identity=62%"; Hit description =ENSANGP00000009226 [Anopheles gambiae str. PEST]
  Gene Ontology: Mol. function=lactoylglutathione lyase activity; Biological process=carbohydrate metabolism
  Coding regions on vcDNA: vcDNA=SeqID_96066; Strand=+; Position=24-558
MTSQNEGAVPAEETKKLVKEKDEATDGFYFQQTMYRIRDPRVSIPFYCNVLGMRLLKQLDFPEGKFSLFFMGYKDLDEIPSDDAAQKKFALSTHSTIELTHNWEHGTDFKGYHNGNSEPRGFGHIGIAVPDVDSACARFEQLGVKFVXKKPNEGRMRGLAFITDPDGYWIEIFNPNNM

SEQ ID NO: 169644 - protein, 249 aa, Heterodera glycines; identical to SEQ ID NO: 162377
  Homolog annotation: Hit_ID=P27442; Match level="QueryCoverage=100%, HitCoverage=69%, E-value=1e-102, Identity=71%"; Hit description=GMP reductase (Guanosine 5'-monophosphate oxidoreductase) (Guanosine monophosphate reductase) gb|AAA29373.1|
  Gene Ontology: Mol. function=GMP reductase activity
  Coding regions on vcDNA: vcDNA=SeqID_96067; Strand=+; Position=107-853

SEQ ID NO: 169645 - protein, 161 aa, Heterodera glycines
  Homolog annotation: Hit_ID=CAF96997.1; Match level="QueryCoverage =99%, HitCoverage=67%, E-value=1e-16, Identity=35%"; Hit description =unnamed protein product [Tetraodon nigroviridis]
  Gene Ontology: Mol. function=RNA binding; Cellular component=nucleus; Biological process=RNA splicing
  Coding regions on vcDNA: vcDNA=SeqID_96068; Strand=+; Position=3-485
ANDSRSSSSASSRSRSRSRSRSPRRREQRRRRSRSTFSRSPSPGQKRLHIGNLDESVRRRDIEDVFGKYGRISDCWMASYPPFYAFVVFENNKDASACMKDLGNTAYIKGCRARVTVALPRNGATYRRGPPPPPRRYYDEEDSHRRRRRSRTRSPRRRRSP

SEQ ID NO: 169646 - protein, 175 aa, Heterodera glycines
  Homolog annotation: Hit_ID=CAE62112.1; Match level="QueryCoverage =98%, HitCoverage=14%, E-value=2e-58, Identity=63%"; Hit description =Hypothetical protein CBG06150 [Caenorhabditis briggsae]
  Gene Ontology: Mol. function=ATPase activity, coupled to transmembrane movement of ions, phosphorylative mechanism; Cellular component=endoplasmic reticulum membrane; Biological process=cell organization and biogenesis
  Coding regions on vcDNA: vcDNA=SeqID_96069; Strand=+; Position=3-527
QSVLYLDGVKFSDIQATIQGIFLAACFLFISRSKPLKTLAKQRPMTNIFNVYTLSTITIQFAVHFACLIHIVRLAHALEERPGKTELEKEFKPNLLNTAVYLMSASLQIATFAVNYRGRPFMESLVENKPLFYSIICSFGAMVAFASNTFPDLNNKFELVHIPVELRDTLICCIL

SEQ ID NO: 169647 - protein, 146 aa, Heterodera glycines
  Homolog annotation: Hit_ID=CAE68995.1; Match level="QueryCoverage =75%, HitCoverage=28%, E-value=9e-25, Identity=47%"; Hit description =Hypothetical protein CBG14982 [Caenorhabditis briggsae]
  Coding regions on vcDNA: vcDNA=SeqID_96070; Strand=+; Position=33-470
MATVAVHVLLDSRVPAQFHSKFIHSFPFRCICPLFRGNVEGHLCILPNGKPLKRAIRKDFRQFSHEEMALFLEVMGRYKSSGLYTRLGMIHRRSGVHSGPSFLTWHREFLKRLEIIFRSLFPQNTDPSLGLPYWDSSLDGDLPSPE

SEQ ID NO: 169648 - protein, 159 aa, Heterodera glycines
  misc_feature (56)..(56): Xaa can be any naturally occurring amino acid
  misc_feature (99)..(99): Xaa can be any naturally occurring amino acid
  Homolog annotation: Hit_ID=AAT48618.1; Match level="QueryCoverage =94%, HitCoverage=32%, E-value=8e-54, Identity=64%"; Hit description =Acetylcholine receptor protein 17, isoform b [Caenorhabditis elegans]
  Gene Ontology: Mol. function=acetylcholine receptor activity; Cellular component=nicotinic acetylcholine-gated receptor-channel complex; Biological process=synaptic transmission
  Coding regions on vcDNA: vcDNA=SeqID_96071; Strand=+; Position=1-475
DCCPNPYPDICYYFSIKRNPSYYLFTLIMPSALITTITVVGFFTPHSTTGENTEKXMMVSDKLPATSNSVPVLGQYYIGLICIQFTATYVTTWTLGLQXGNSGRTIPRRLRRWLMRVNAHGNFFVRHLLGRELRCTQQSIRNRMSKFDQLLDRADDRPS

SEQ ID NO: 169649 - protein, 151 aa, Heterodera glycines
  Homolog annotation: Hit_ID=NP_496453.1; Match level="QueryCoverage =100%, HitCoverage=100%, E-value=3e-30, Identity=47%"; Hit description=esophageal gland cell secretory protein 11 like precursor family member (15.2 kD) (2L776) [Caenorhabdit
  Coding regions on vcDNA: vcDNA=SeqID_96072; Strand=+; Position=39-494
MKFSLLLAFAFAVPLANAALTFPSIGYVQSAAVNGTLTCNGKPTHAKVKLYDEDDTDMDDLMDEGVTDEEGFFHLSGKESEITPIEPKVNIYHNCNDDESLNPLKKVCYKKISIDLPASYITDGPVAEKVFPLGTLNLAGSFKGETRDCLN

SEQ ID NO: 169650 - protein, 166 aa, Heterodera glycines
  Coding regions on vcDNA: vcDNA=SeqID_96073; Strand=+; Position=3-503
SVQWDKVPYFYPIQIIQFGLGQYNLDRKGAEVIVRPLANRATNAMGTENANGTMALGDGATVRVKLFRRLPLLLFSLKTHRMDSEFVLELEKRRREGGTMEMALFFKHSEAKGCVWSDESIKAPRLSAVFNIGPKPTMRWVDFVIDNDIYVTKALKCYVPEKTDSK

SEQ ID NO: 169651 - protein, 284 aa, Heterodera glycines
  Homolog annotation: Hit_ID=NP_492670.1; Match level="QueryCoverage =91%, HitCoverage=32%, E-value=6e-30, Identity=30%"; Hit description =putative protein of ancient origin (1K696Co) [Caenorhabditis elegans] pir||T26415 hypothetical protein Y1
  Gene Ontology: Mol. function=DNA helicase activity; Cellular component=alpha DNA polymerase:primase complex; Biological process =DNA replication
  Coding regions on vcDNA: vcDNA=SeqID_96074; Strand=+; Position=3-854
SPVNSAERLHISLLEYINETFKNEDFYHFLSVQYRSNELIQKWSNKIFYDNKLVTYQLTKNIHLRQIINQQNADLSSGPLSSKQKFLIDGPLVLIDTDKGISDSKWQKVYSLFKLWYPLSFREGQNEHTHSFHNIGEAFCAVLHLHALNLFGGLDLSKIGCITPYSAQAEKIQKLMAMGRDEGPRFEVSSVDAFQGQQREAIVMSLVRNNKMRDIGFLREHRRTNVAITRAKRQFLLIASSRMLNVDRLLRELYGVIRTDGLVVGPDALLPIAHEIWQCHLERK

SEQ ID NO: 169652 - protein, 186 aa, Heterodera glycines
  Homolog annotation: Hit_ID=NP_506031.1; Match level="QueryCoverage =98%, HitCoverage=40%, E-value=6e-64, Identity=61%"; Hit description =Alpha-N-Acetylgalactosaminidase precursor (51.4 kD) (5M569) [Caenorhabditis elegans] emb|CAB00120.1| Hypo
  Gene Ontology: Mol. function=alpha-N-acetylgalactosaminidase activity; Cellular component=lysosome; Biological process =carbohydrate metabolism
  Coding regions on vcDNA: vcDNA=SeqID_96075; Strand=+; Position=1-558
AKHPFSCINEQLYMDMADRLAEDGFREVGYQFVHIDDCWAEKARDSQGRIVADPTRFPSGIRNLSDYMHNRGLKLGIYGDIGTETCENYPGSYQHYDIDAQTFADWKVDYLKLDGCYMNSSMMPDEYPKMGVALNRTGRQIVYSCSWPDYFDHNFEEKINYTAVAYWCNLWRNFDDIARSWASVIK

SEQ ID NO: 169653 - protein, 160 aa, Heterodera glycines
  Coding regions on vcDNA: vcDNA=SeqID_96076; Strand=-; Position=1-480
TNIIKRSVFHRINSWLSHLNTACLSTSHQILTKVSALVHANRILHDDNSPNLRKFTRKQIATGQRLSTVSQTEVQHATIVRFDLFILCRETECRRVKVLRLCLHHVRLNTNTVSTKEWVIVLNHPFVALCLNATRQIDGQNLAFSDHLLSEFRRLFVERN

SEQ ID NO: 169654 - protein, 137 aa, Heterodera glycines
  Homolog annotation: Hit_ID=AAP30770.1; Match level="QueryCoverage =83%, HitCoverage=43%, E-value=4e-28, Identity=53%"; Hit description =putative gland protein G17G01 [Heterodera glycines]
  Coding regions on vcDNA: vcDNA=SeqID_96077; Strand=+; Position=63-473
MRKFAYFKLCQAVLTSVFLWQILSTHQFCGEFDEPTAFFNSAVSSSHCEQFTLIGMDSTTGEYGAMPDKQKWHMQLMASSGSGQPIDEQQQNHMDEFSSKLPTVGRHCIPIAFSLVKPWVRDNKSHLQKVADLFAIQ

SEQ ID NO: 169655 - protein, 127 aa, Heterodera glycines
  Homolog annotation: Hit_ID=AAP30770.1; Match level="QueryCoverage =97%, HitCoverage=43%, E-value=6e-23, Identity=48%"; Hit description =putative gland protein G17G01 [Heterodera glycines]
  Coding regions on vcDNA: vcDNA=SeqID_96078; Strand=+; Position=93-473
MRKFAYFKLCQAVLTSVFLWQILSTHQFCGEFDEPTAFFNSAVSSSSAGGHCDQQFTLIGMDSTTGEYGAVPDKQKWHMQLMASSGGGQGQPIDEQQQQQKNQMEEFSSKLPTVGRHCIPIAFSLVN

SEQ ID NO: 169656 - protein, 134 aa, Heterodera glycines
  Coding regions on vcDNA: vcDNA=SeqID_96079; Strand=-; Position=203-607
SKKGIHQQTKQMKNNPKKEKWQSNKKIEILFHLINRIGQNEMKVAYRMCDCSRFAFKVPFFCDRRFSSSSSSSSLLVPLMSETFRTIPSLVPPAFRAHSPTICPSKMRTVCTWSHPQCPSHRHPLSAHNWQMSC

SEQ ID NO: 169657 - protein, 89 aa, Heterodera glycines; identical to SEQ ID NO: 165740
  Coding regions on vcDNA: vcDNA=SeqID_96080; Strand=+; Position=1-270

SEQ ID NO: 169658 - protein, 293 aa, Heterodera glycines; identical to SEQ ID NO: 162562
  Homolog annotation: Hit_ID=CAA65506.1; Match level="QueryCoverage =100%, HitCoverage=93%, E-value=9e-82, Identity=52%"; Hit description= cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_96081; Strand=+; Position=1-882

SEQ ID NO: 169659 - protein, 157 aa, Heterodera glycines
  Homolog annotation: Hit_ID=CAE75294.1; Match level="QueryCoverage =100%, HitCoverage=13%, E-value=3e-70, Identity=80%"; Hit description= Hypothetical protein CBG23262 [Caenorhabditis briggsae]
  Gene Ontology: Mol. function=pyruvate carboxylase activity; Cellular component=cytosol; Biological process=TCA intermediate metabolism
  Coding regions on vcDNA: vcDNA=SeqID_96082; Strand=+; Position=3-473
EYYLNLAKQLVNANAHILSIKDMAGVLKPEAAKLLITALRDQHPDVPIHVHTHDTSGAGVASMIECARAGADAIDAAIDSMSGMTSQPSMGAIVASLQRTPHSTGLEMDSISRYNAYWETARQFYQPFECTVTMKSGNSDVYNHAIPGGQYTNLQFQ

SEQ ID NO: 169660 - protein, 211 aa, Heterodera glycines
  Coding regions on vcDNA: vcDNA=SeqID_96083; Strand=+; Position=2-634
MSDHFWDENVFDLIVELEKEGRHVRLDWLSSNSALVDRFQTDIARLSEEEYSLYAASSSKLQRIAAAECAYKYNRTEELDKLFEKDRDSEALRETNVRHFLINRILDEFRPNIRRLSALPIERTIDAFCLNQPKDIEQHVLDVYDFLMDCPEAPAAAEAAAPSYQGGQESSGTAEQPQEAAAPEAPAAAEAAAPSYQGGQESSGTAEQPQE

SEQ ID NO: 169661 - protein, 193 aa, Heterodera glycines
  misc_feature (93)..(93): Xaa can be any naturally occurring amino acid
  misc_feature (130)..(130): Xaa can be any naturally occurring amino acid
  Homolog annotation: Hit_ID=NP_491464.1; Match level="QueryCoverage =92%, HitCoverage=47%, E-value=1e-38, Identity=45%"; Hit description =carbohydrate kinase, PfkB (1F417) [Caenorhabditis elegans] gb|AAK73885.1| Hypothetical protein F57C9.1b [
  Gene Ontology: Mol. function=pyridoxal kinase activity; Biological process=coenzymes and prosthetic group metabolism
  Coding regions on vcDNA: vcDNA=SeqID_96084; Strand=+; Position=2-579
NSVQFSNHTQYPNVKGQRLNERDLAELFDGIRNADLPAKYSHILTGYCGDASFLRQIASIVRECRQHNPKLTYVCDPVMGDNGKYVSRIRHFXKAFMSKYNGIPRELCSIYRDELLPLSDVITPNAFELXDIAIANERDCLRAMEHFHRVKRIRIVVVTSGVPDETTKNKSMMHCYASEAIPSAVDTIRVRYF

SEQ ID NO: 169662 - protein, 126 aa, Heterodera glycines; identical to SEQ ID NO: 162961
  Homolog annotation: Hit_ID=CAE66292.1; Match level="QueryCoverage =65%, HitCoverage=71%, E-value=9e-14, Identity=43%"; Hit description =Hypothetical protein CBG11539 [Caenorhabditis briggsae]
  Coding regions on vcDNA: vcDNA=SeqID_96085; Strand=+; Position=20-400

SEQ ID NO: 169663 - protein, 183 aa, Heterodera glycines
  Homolog annotation: Hit_ID=CAE67776.1; Match level="QueryCoverage =85%, HitCoverage=14%, E-value=2e-23, Identity=39%"; Hit description =Hypothetical protein CBG13351 [Caenorhabditis briggsae]
  Coding regions on vcDNA: vcDNA=SeqID_96086; Strand=+; Position=1-552
THSDGEPPRIRCRWPICENTPRTLCNPSVLPYKEYVYHIRQQFERSRERTSAQNAYSDFAAQEAIRRHAFANLRKEITEDSEGPVTRSIRLTSALILRNICHHSVAGRRKLRTHESFISWLSLSHMESARTLAQCLSEMARHANNETEPQRNVIKRKTSCSSGDLQQNQPSFASEQMDDNDTA

SEQ ID NO: 169664 - protein, 76 aa, Heterodera glycines
  Coding regions on vcDNA: vcDNA=SeqID_96087; Strand=-; Position=196-426
MVVEADLVTGRNWESTLVDGLSLVGIGDRPDPSADAMVVEADLVTGRNWESTLVDGLSLVGIGGRPDPSASNFLIR

SEQ ID NO: 169665 - protein, 157 aa, Heterodera glycines
  Coding regions on vcDNA: vcDNA=SeqID_96088; Strand=+; Position=2-472
PTELQFLDESVADEEAVLGSEITLHQHKMEKEEETTFEEHDDMTAPKSVFGSSSFGCNKREHCKSDDEDYCHSACEEGPTEETKNHSPPEESSKEKEGEQAEDTGTGMTDIVEAEALTEPGTPLRQMDETTNSQRNEEETCPIREEEQQTKTEENST

SEQ ID NO: 169666 - protein, 205 aa, Heterodera glycines
  Homolog annotation: Hit_ID=NP_492076.1; Match level="QueryCoverage =94%, HitCoverage=48%, E-value=2e-28, Identity=38%"; Hit description =kappa B-ras (1H925) [Caenorhabditis elegans] emb|CAA96623.1| Hypothetical protein F52A8.6a [Caenorhabditi
  Gene Ontology: Biological process=anti-apoptosis
  Coding regions on vcDNA: vcDNA=SeqID_96089; Strand=+; Position=31-645
GSCPSAAHCQQKRRRKGKMRTKMHVVVLGPKKVGKTSLLKSLINQHDPKPSTSSSDGQLYVPTVEDTFHVQFGDFRSVDQMPQRSLLILFHDTAGITDFGSIELRKPYLQVADAFLLVYSVLDPLALSQMEALKKYLEREKNGTSKERKEVPIAVVGTNCEMSGKKVNTESALLWASREKVKLFEVSANDRKSVAEIAQHLSERL

SEQ ID NO: 169667 - protein, 128 aa, Heterodera glycines
  Coding regions on vcDNA: vcDNA=SeqID_96090; Strand=-; Position=238-624
LTLAILTPSGEGRFGIGRGGEKPTSHERVLLLSLLRFPLALVCRRLPRVVLFPSEPCHHFRALLLNDGFRCARLRLSFGRLIVSPSHGKASSVASAEIANLNAKSNNKQQLIVNMDNTDGTKQKPNYF

SEQ ID NO: 169668 - protein, 207 aa, Heterodera glycines
  Coding regions on vcDNA: vcDNA=SeqID_96091; Strand=+; Position=65-685
MDSENALQSFKEFTGCTDDDSARRLLSKCAWNLERAIDFFFSGRREEGDGEVMWDEQQPMTSQGTRRRISHFANSLWTTPAIGGNAANGNRRTDETSHNQFRTARMDDDSVQTLDDSDVQMVEESDRKAAPPPKAVNGSASSDGVRAPIAPVQGVLIEQSFRETYQNRERLWNPVFEQYRQDHQQPSSSSAAASFLSRRANGANNRI

SEQ ID NO: 169669 - protein, 153 aa, Heterodera glycines
  Homolog annotation: Hit_ID=NP_723895.1; Match level="QueryCoverage =79%, HitCoverage=5%, E-value=2e-12, Identity=33%"; Hit description =CG7595-PA, isoform A [Drosophila melanogaster] ref|NP_523571.1| CG7595-PB, isoform B [Drosophila melanogas
  Gene Ontology: Mol. function=myosin ATPase activity; Biological process=hearing
  Coding regions on vcDNA: vcDNA=SeqID_96092; Strand=+; Position=2-460
YIIGDSELELARAFRTPCPLCLITISVPASLYAVFRDEAKSNSRNFVSHTTPPAQLRSCSIFDDAQMFVPIHLTDGRVISLPIDSQSTPFELCEMLCQQICLKDAFGFGLFLAVGRRFIRSLGVGSECVIDAIASLETKSEKNWRIFFKKELF

SEQ ID NO: 169670 - protein, 261 aa, Heterodera glycines
  Homolog annotation: Hit_ID=EAL47348.1; Match level="QueryCoverage =60%, HitCoverage=94%, E-value=3e-34, Identity=46%"; Hit description =ubiquitin-conjugating enzyme, putative [Entamoeba histolytica HM -1:IMSS]
  Gene Ontology: Mol. function=ubiquitin-protein ligase activity; Cellular component=endoplasmic reticulum; Biological process =conjugation with cellular fusion
  Coding regions on vcDNA: vcDNA=SeqID_96093; Strand=+; Position=85-870
MSSSHRETGRSPRSVLMRQYEMLLQNSNDNSGFRAWFDNNNLFKWRILIDGPPGTPYAGCKLTALLHFPASYSNDPPTMTFLTDILHPNIDQSGKVCISILHAPGIDPLGHEQPSERWNPNRSVESILVSIQVLLAEPNFNSPANVDAAILFRNDPAQYRKEVRRRVEMEIARTAPILPGAQPPPEEQGTQPPEEQGTTQAAEEQRAQPPEEQGTQPPEQQGTTQPLEQQVTTQAVEEQGTQQPATPPPEGPQQQTDEWYM

SEQ ID NO: 169671 - protein, 148 aa, Heterodera glycines
  Homolog annotation: Hit_ID=AAN38989.1; Match level="QueryCoverage =96%, HitCoverage=34%, E-value=7e-15, Identity=37%"; Hit description =prion protein [Salmo salar]
  Gene Ontology: Mol. function=protein binding; Cellular component =nucleoplasm
  Coding regions on vcDNA: vcDNA=SeqID_96094; Strand=+; Position=188-631
MSSGGYNNQSNYPGGAHPQQYGTGNTGNAGGYPPAAPPSAGAYPPQQYGGIAPPYGTAGYPPQYQPTPYPTSTGGYAPSSGASIGFNIDAPSAGGGGYPPYQPNLGGGGAPVPSPYPQQTAPYQQPPYHTTGGGAGAYPTQTFGSQPQ

SEQ ID NO: 169672 - protein, 144 aa, Heterodera glycines
  Coding regions on vcDNA: vcDNA=SeqID_96095; Strand=+; Position=3-434
KFEFSEKMFYERALTEWRDKILKDSGNKNHAFVLRKALCNLKLFSLDVNGFSDLRKIRGIGVDIATRLSSAWKFTCATHFCTESPTIGQIKSLKSGEAFVLIEQSSTENGGRVPLVAGAKQRKAIPSQIGQQQKSQTNGKQKGH

SEQ ID NO: 169673 - protein, 206 aa, Heterodera glycines
  Homolog annotation: Hit_ID=AAC47437.1; Match level="QueryCoverage =100%, HitCoverage=95%, E-value=1e-102, Identity=63%"; Hit description=COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_96096; Strand=+; Position=28-645
MDFEARIKAYRFVAYSTVSFSIISLLSVCFTLPMLQNYVSNVAQNMDRELSACQGSAKDIWSEVNQLKSIPVVGGNRTARQADGYGGGGGAVSGGGGGGGSCSECCSGGGPGPAGPPGPPGNPGNPGAPGSPGQPGKSVSAPCEQATPPPCKPCPGGQPGQPGPPGPPGQPGSPGQPGSGGGNPEPGPPGPPGPPGNPGGPGQPGG

SEQ ID NO: 169674 - protein, 160 aa, Heterodera glycines
  Homolog annotation: Hit_ID=NP_956352.1; Match level="QueryCoverage =49%, HitCoverage=41%, E-value=1e-10, Identity=37%"; Hit description =Unknown (protein for MGC:73197) [Danio rerio] gb|AAH59545.1| Unknown (protein for MGC:73197) [Danio rerio
  Coding regions on vcDNA: vcDNA=SeqID_96097; Strand=+; Position=3-482
MSNQSTSSAAAAAGSTAPPSPSNEASSPSAAQASSQSSSAAGDSSASPNGPRLKPRKVPVNRFRDVRPALQLRLSQLKHPLIRKLEQDTGIDRERLFYMAMAYFVFLLLFTQCKLLLSTLIGSVYPAYQSIVTVHTQAKSEEIQWLTYWCLFSLFSLCDI

SEQ ID NO: 169675 - protein, 149 aa, Heterodera glycines
  Homolog annotation: Hit_ID=CAE57443.1; Match level="QueryCoverage =80%, HitCoverage=33%, E-value=2e-10, Identity=36%"; Hit description =Hypothetical protein CBG00405 [Caenorhabditis briggsae]
  Gene Ontology: Cellular component=mitochondrion
  Coding regions on vcDNA: vcDNA=SeqID_96098; Strand=+; Position=28-474
MIPLFPLRGPFSSFPRTFHSKSPLHQTKTSLLVGPAVRLLLGHYDIKTSVLRASGPKKNILKSDVLSHINDKKLSPIKAFSAKPPSKMSLENEVISASSHPIIPLKSSGRSEPTHRHVHVDIQLSEMRQNQTKQFVQSRNSIPHAYASA

SEQ ID NO: 169676 - protein, 103 aa, Heterodera glycines
  Coding regions on vcDNA: vcDNA=SeqID_96099; Strand=+; Position=3-311
VTLEGRTRLPQRVQELVIDIGNAMTSIQQTSGSTDLLITSIRNFTSSDGIMANSEQNLVKIQNQMDRIETQTNGAEQNLKNVSSVNNFLDALEQSAYCTNFDD

SEQ ID NO: 169677 - protein, 212 aa, Heterodera glycines
  Homolog annotation: Hit_ID=NP_498282.1; Match level="QueryCoverage =100%, HitCoverage=100%, E-value=1e-82, Identity=68%"; Hit description=kdel receptor (24.7 kD) (3G997) [Caenorhabditis elegans] gb|AAA62292.1| Hypothetical protein C28H8.4 [C
  Gene Ontology: Mol. function=KDEL sequence binding; Cellular component=cytoplasmic vesicle; Biological process=intracellular protein transport
  Coding regions on vcDNA: vcDNA=SeqID_96100; Strand=+; Position=52-687
MNAFRLIADLSHLFAILILLWKIWKTRSCAGLSGKSQVLFALVFTCRYLDILHFISIYNTLMKVLFIGSLFATCYFMFVKFRATYNKDEDTFRVELLVLPCIVLALFVNADFTALEVLWTFSIYLEAVAILPQLFMLQKRGEAETITAHYLFLLGIYRALYIFNWVYRYYTEAFYDPIVIVSGIVQTVLYADFFYLYVTRVVKDGAKLELPI

SEQ ID NO: 169678 - protein, 151 aa, Heterodera glycines
  Coding regions on vcDNA: vcDNA=SeqID_96101; Strand=+; Position=29-481
FYFIKVANKMALAKLKTSVFAIFVVLFVSIDKCRCTNILFTFFHDTGSHFQSVFPLMQKLASRGNNVSVLDTVYEQDHSLEIHHFRALLPKHHNDETSKRHFANDIWSRRLSATDLALYFGTCDKELGILMQNHSQKIVQLFDTNWDVIVL

SEQ ID NO: 169679 - protein, 103 aa, Heterodera glycines
  Coding regions on vcDNA: vcDNA=SeqID_96102; Strand=+; Position=2-313
LSLSNSSFDKVKDQMGKMNSKLIKMESEVRKWKNQAEDNARRVSALSDEKVEIERNLSLKDRQLVQLQELCRVLKREGDKPNRQNENGEVTERDGELEAGAID

SEQ ID NO: 169680 - protein, 222 aa, Heterodera glycines
  misc_feature (133)..(133): Xaa can be any naturally occurring amino acid
  Homolog annotation: Hit_ID=AAC47437.1; Match level="QueryCoverage =93%, HitCoverage=72%, E-value=3e-71, Identity=58%"; Hit description =COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_96103; Strand=+; Position=21-685
MADFEGRVKAYRFVAYTTVSFSIISLLSVCLTLPMLKSYVSNVGMKMDSELSSCQHNAKDIWSEVSQLKGMPLLVAGNRTARSAYGSCQECCSGGAQGQPGQPGQPGRPGNPGAPGSPGQPGQTPQTPCEQVXPASPPPTEPAPAGPPGEAGAPGQPGQPGAPGQPGAAGQPGPKGPPGGPGQPGNGGAPGQPGQPGQPGNPRIATECVPYTVHGTEDGSLR

SEQ ID NO: 169681 - protein, 155 aa, Heterodera glycines
  Coding regions on vcDNA: vcDNA=SeqID_96104; Strand=+; Position=14-478
MPSARVSSADSSAVSVSNKGISLGLSSSGTSPSNVIVSSVPVNSGTFRGLSPIGNVSSLVRDVFGPLAAVRRQSPTVQVAAGAGGGIIAGYVFGKTSKMVAILLGSTVLFLQFAQCKGYLQIQNGKLREDFEAARDKLGEMIDGMGAIGGEAVVG

SEQ ID NO: 169682 - protein, 158 aa, Heterodera glycines
  Homolog annotation: Hit_ID=XP_417810.1; Match level="QueryCoverage =91%, HitCoverage=82%, E-value=4e-32, Identity=50%"; Hit description =PREDICTED: similar to archease [Gallus gallus]
  Coding regions on vcDNA: vcDNA=SeqID_96105; Strand=+; Position=3-476
SVSPPPPPSSNECPPPLVPCQYEYLDHTADVQLHAWGQSLGEALEQLTIALYGYMTIEIDRVEPIYTMDFSASGHDLSALVYNLLDNCLYSFCAEPFFIGRFAKFLNLKKPSGNTGEELSVQIRIWGESFDPQKHPQGTEIKAITYSNMQIIRKEEEE

SEQ ID NO: 169683 - protein, 166 aa, Heterodera glycines
  Coding regions on vcDNA: vcDNA=SeqID_96106; Strand=+; Position=40-540
QMALSSRRGFFLLAGIFAFSSVLQMLVFRHFYIEHIFNLISPILLLCGSVPIIVGEMRGQRTSKMYRPFLITTAISFAITAFPELVGKVLRFIRAGFDTHYFLDLWPYTLALISIWLYPIVYRAYKFVQQNEEHKNGGPYGQNAKVINQQYAKVVPMPLPNAEMIG

SEQ ID NO: 169684 - protein, 152 aa, Heterodera glycines
  Homolog annotation: Hit_ID=CAE72569.1; Match level="QueryCoverage =82%, HitCoverage=10%, E-value=2e-16, Identity=33%"; Hit description =Hypothetical protein CBG19756 [Caenorhabditis briggsae]
  Coding regions on vcDNA: vcDNA=SeqID_96107; Strand=+; Position=18-473
MFKFAKPMTTTAARMIARKSRLEVMPMAKKYTESGYQRELTYRRSDYSFPAFCESDVTHFKRGEVHHKLMQGGASEGGFTLTAYVLVALLENHVQNKVTELARSYLVSHLADFKEDPYALTLCTYVLHLANSPEKGDVLKMLEGLQTTGTTD

SEQ ID NO: 169685 - protein, 115 aa, Heterodera glycines
  Homolog annotation: Hit_ID=CAE75515.1; Match level="QueryCoverage =92%, HitCoverage=39%, E-value=3e-15, Identity=47%"; Hit description =Hypothetical protein CBG23530 [Caenorhabditis briggsae]
  Coding regions on vcDNA: vcDNA=SeqID_96108; Strand=+; Position=99-443
MIGSTARCVALLLLGATMAQAFLTTFNVAPNAFRNRRGCGGGGGGGCGGAPPSVGGPVQLTLGCGGAPQPQQAPPPSGGCGGGGCGGGGCGAPPPNGGGAIKLTLGCERPPPQAP

SEQ ID NO: 169686 - protein, 139 aa, Heterodera glycines
  Coding regions on vcDNA: vcDNA=SeqID_96109; Strand=+; Position=24-443
MKPLKIDVDFPSNSHPTSQELNQDCIPLYEMLEFEELQFPNYYLSEQLGRGAHATVMPCHFHGKPAAAKLFNANVDFKTIQKEAKLLHEFRHENIIELYALFHGTMSGLVLELMEGGSLSECESNFGISKRTDKSLCQQ

SEQ ID NO: 169687 - protein, 180 aa, Heterodera glycines
  Coding regions on vcDNA: vcDNA=SeqID_96110; Strand=-; Position=1-540
QPISAFDLTHFGQDSDIFLGVFIDCVRFRFAESAVPFAKQSGDCGQSPEEEIPRKMFTIERTVHQFIVKGASEKVVDIRNNANGIFMPRGVGERIKQMGQRIGKGFDIDGIAKANPGKDVQISKKTHQTIPGKQQRVDFGFVQTGVIGKLKREKCLENTVAVPTDVNGPPNYSQFRRSPT

SEQ ID NO: 169688 - protein, 213 aa, Heterodera glycines
  Homolog annotation: Hit_ID=XP_213672.2; Match level="QueryCoverage =81%, HitCoverage=10%, E-value=4e-13, Identity=27%"; Hit description =similar to zinc finger protein 294 [Rattus norvegicus]
  Coding regions on vcDNA: vcDNA=SeqID_96111; Strand=+; Position=3-641
EEQSHQLALPRLFKALLSFEFANYSRLNESEVDPLLLSWDVLMRFFGDLDVLSRVRFCDAIDVKTLSNALAHLFNSLSDPPGHKDAICVVSNVDELFAGPFHYKLVDRPFDREHFTSNLFFRTLATIPALFREWHGTLSKTEANTVNEYTQKYLSHLLIQRELRSLENMKRGRLEVRILSKVREIECTYRLEETTMTLTILLPENYPIKAPEV

SEQ ID NO: 169689 - protein, 151 aa, Heterodera glycines
  Coding regions on vcDNA: vcDNA=SeqID_96112; Strand=+; Position=12-464
MLSVWLDLAPKCAIAEAIASGTGTTVGGTARTSASKRGGKAAAAAAAPAGVATQPHDPNREMRDAFKRLDRAYFFSSYSQMISRITHSDAATYALLKEMLSELIVHFPHRCLWLSQSIVRSTRVAVRSKRCLEIFELAKKKARSNNDNNAA

SEQ ID NO: 169690 - protein, 135 aa, Heterodera glycines
  Homolog annotation: Hit_ID=NP_502166.1; Match level="QueryCoverage =99%, HitCoverage=85%, E-value=6e-39, Identity=57%"; Hit description =multiprotein Bridging Factor, transcriptional coactivator (17.1 kD) (mbf-1) [Caenorhabditis elegans] emb|
  Gene Ontology: Mol. function=transcriptional activator activity; Cellular component=nucleoplasm; Biological process=regulation of transcription, DNA-dependent
  Coding regions on vcDNA: vcDNA=SeqID_96113; Strand=+; Position=3-407
NTVTILRKHQAPQRVLKSDAAVNAAKKRGDDVETTKKYFAGVNRQHKTDKNTAVLDAETEQLHHERVSLKLGTVIQQARQAKEWTQKELATRANEKVEVIREYENGKAVPNQSILTKMERCLGVKLRGKELGQPL

SEQ ID NO: 169691 - protein, 84 aa, Heterodera glycines
  Homolog annotation: Hit_ID=NP_499368.1; Match level="QueryCoverage =55%, HitCoverage=5%, E-value=4e-09, Identity=63%"; Hit description =mammalian RIB-affecting EXT family related, brother of tout velu (Drosophila)/ human multiple exostoses ho
  Coding regions on vcDNA: vcDNA=SeqID_96114; Strand=+; Position=1-255
ASPCFLPFANFLPSDSEFGEDTSFGMRPVLPGSGQEFALALGGNRPREQFTSFNWGLLSFAVLLSLPFYSNHSRLQSRTSVVGQ

SEQ ID NO: 169692 - protein, 95 aa, Heterodera glycines
  Coding regions on vcDNA: vcDNA=SeqID_96115; Strand=+; Position=44-331
MAEDEVDDLLEEAFKNVDEAEKNGTKMDDVIKKKAKEVGIKMNDSEGKRKRSRSGSRERKRRRSRSREKKKRDSSRERRRRSPSENSKRKRRSRS

SEQ ID NO: 169693 - protein, 289 aa, Heterodera glycines
  Coding regions on vcDNA: vcDNA=SeqID_96116; Strand=+; Position=239 -1105
MPRWRTMEGLDMKWQFRSVTSSRKGTQWKVRWERKRRKKRRDKTTAQCDRLPTKLGELSLDEDKTANTDAVVEPPMATEEKAADVGNDKPSGENLNEENNESKGYQSPVSEEEHPIQHVDAKQPTVDEGQTHAAAADSLPPSEPTTDSSAENDGNNEIVSPTALEPQLVPTSDEEEQKPKNAVEAGDDGAAKDNTLSSGGATASDETAAVAAFSAGTPPPVPAVGQQPQQQTEHQLSQHQQQAELCGAKTAVAAESTARDSAEDETDASSSARQSVPAKGGTDGKAHGG

SEQ ID NO: 169694 - protein, 82 aa, Heterodera glycines; identical to SEQ ID NO: 165678
  Coding regions on vcDNA: vcDNA=SeqID_96117; Strand=-; Position=0-245

SEQ ID NO: 169695 - protein, 237 aa, Heterodera glycines
  Homolog annotation: Hit_ID=NP_506376.1; Match level="QueryCoverage =92%, HitCoverage=92%, E-value=3e-91, Identity=71%"; Hit description =nadh dehydrogenase (26.2 kD) (5O106) [Caenorhabditis elegans] emb|CAB01203.1| Hypothetical protein F53F4.
  Gene Ontology: Mol. function=NADH dehydrogenase activity
  Coding regions on vcDNA: vcDNA=SeqID_96118; Strand=+; Position=2-712
SKHLRNFPFGCPFAARPLRRYSAHGLQVHRDNERNNPNTPFQFTEANLAKITVLLNNFPEGHKGAALIPVLDLAQRQHGWLPISAMHEVARVLEMPRMRVYEVATFYTMFNRDPVGKYFLQVCGTTPCMLRGAEAIIEAIEKKLGIKKGGTTADGLFSLQEVECLGACVNAPMVQINDDYYEDLTPRDIEEIIDEFKAGKRPLPGPRSGRLAAEPLAKQTTLTETPPGPGFGLQQGL

SEQ ID NO: 169696 - protein, 157 aa, Heterodera glycines
  Homolog annotation: Hit_ID=CAE61812.1; Match level="QueryCoverage =92%, HitCoverage=4%, E-value=8e-25, Identity=41%"; Hit description =Hypothetical protein CBG05779 [Caenorhabditis briggsae]
  Gene Ontology: Mol. function=ubiquitin-protein ligase activity; Cellular component=cytoplasm; Biological process=embryogenesis and morphogenesis
  Coding regions on vcDNA: vcDNA=SeqID_96119; Strand=+; Position=4-474
MTNNLDETNPLVEQALNVIKILHELSRSISNFDQIIGVEVTFPTLPEESFHSTKLSQKLCQELTDPLVVSAKALPNWCNYLVHNFPCLFSMDIRTSFMNTTAFGTSRAIAYLQSRRDHLLDQNRSATSSAASNMAGLRREDHYPEYRIGRVKHERIK

SEQ ID NO: 169697 - protein, 147 aa, Heterodera glycines
  misc_feature (50)..(50): Xaa can be any naturally occurring amino acid
  Homolog annotation: Hit_ID=CAH68989.1; Match level="QueryCoverage =90%, HitCoverage=25%, E-value=1e-17, Identity=39%"; Hit description =novel BTB (POZ) domain containing protein [Danio rerio]
  Gene Ontology: Mol. function=protein binding
  Coding regions on vcDNA: vcDNA=SeqID_96120; Strand=+; Position=34-475
MLARMKKLLSSGDHADVNFLIGNEDSKEILLAHKAILSVASDVFAAMFRXDATNATRATVGKPFLRPVEITDVEPSAFKVLLNFIYWDDLSERNGDNAIALLYAAKKYKIPELVKACVEFPVSELRDIFSALVRTRILEEEEFAARC

SEQ ID NO: 169698 - protein, 139 aa, Heterodera glycines
  Homolog annotation: Hit_ID=NP_510431.1; Match level="QueryCoverage =100%, HitCoverage=4%, E-value=1e-34, Identity=49%"; Hit description =g-protein beta WD-40 repeat (XP243) [Caenorhabditis elegans] emb|CAB01916.1| Hypothetical protein F54E4.1
  Gene Ontology: Mol. function=protein binding
  Coding regions on vcDNA: vcDNA=SeqID_96121; Strand=+; Position=3-419
DTLRDNDDYQLLIPGSDGQPGKNIPTQTSAHLRKRLFSGVRRLEAHSSLPYYASGSSDGSVFLWEWGVEQPVFVARVAGQFAKVAKLAFAQNGARFAAVDGDGLLSIWQAQPGVPAKKPYFIQKCHTKFASDVKFLGQT

SEQ ID NO: 169699 - protein, 314 aa, Heterodera glycines; identical to SEQ ID NO: 162930
  Homolog annotation: Hit_ID=BAC06575.1; Match level="QueryCoverage =98%, HitCoverage=96%, E-value=1e-161, Identity=64%"; Hit description= As37 [Ascaris suum]
  Gene Ontology: Mol. function=structural constituent of muscle; Cellular component=sarcomere; Biological process=striated muscle contraction
  Coding regions on vcDNA: vcDNA=SeqID_96122; Strand=+; Position=18-962

SEQ ID NO: 169700 - protein, 200 aa, Heterodera glycines
  misc_feature (178)..(178): Xaa can be any naturally occurring amino acid
  Homolog annotation: Hit_ID=NP_502202.1; Match level="QueryCoverage =75%, HitCoverage=61%, E-value=5e-38, Identity=50%"; Hit description =tafazzin (4M416) [Caenorhabditis elegans] emb|CAA92638.1| Hypothetical protein ZK809.2 [Caenorhabditis el
  Gene Ontology: Mol. function=acyltransferase activity; Cellular component=integral to membrane; Biological process=phospholipid biosynthesis
  Coding regions on vcDNA: vcDNA=SeqID_96123; Strand=+; Position=56-656
MDSPPTSTSKLMQIPLLSAKRRKEVLNFQWPFPKHPGLLYRLGSNAVILAVFSLAKLVFCFNKILVQPEQKKLVLDLLNDRNRPLVTISNHRCVVDDPLIWSMFTFREFLSNISRFRYILTAHDICFTKKSHIFFFSLGRCVPVVRGAGVFQEGVDHCVDMLNSNGWVHVFPEGRVTXESVRIKWGIGPINFRNRTNPPI

SEQ ID NO: 169701 - protein, 148 aa, Heterodera glycines; identical to SEQ ID NO: 163808
  Homolog annotation: Hit_ID=NP_501211.1; Match level="QueryCoverage =94%, HitCoverage=49%, E-value=4e-32, Identity=47%"; Hit description =voltage-dependent anion channel 2 (30.0 kD) (4I272) [Caenorhabditis elegans] gb|AAB00622.2| Hypothetical
  Gene Ontology: Mol. function=voltage-dependent anion channel porin activity; Cellular component=integral to plasma membrane; Biological process=adenine transport
  Coding regions on vcDNA: vcDNA=SeqID_96124; Strand=+; Position=19-462

SEQ ID NO: 169702 - protein, 155 aa, Heterodera glycines
  misc_feature (118)..(118): Xaa can be any naturally occurring amino acid
  Homolog annotation: Hit_ID=CAE75294.1; Match level="QueryCoverage =100%, HitCoverage=12%, E-value=1e-28, Identity=49%"; Hit description= Hypothetical protein CBG23262 [Caenorhabditis briggsae]
  Gene Ontology: Mol. function=pyruvate carboxylase activity; Cellular component=cytosol; Biological process=gluconeogenesis
  Coding regions on vcDNA: vcDNA=SeqID_96125; Strand=+; Position=2-467
KLLITALRDQHPDVPIHVHTHDTSGAGVASMIECARAGADPIDAAIDSMNGMTSQPSMGAIWGFVGTGTGLSPGWENDPVFPNTTLYWGTGPYIFPNPSKCPRNNKKGGNSECEKNTXPRGGKFKKFHFPGFFLGGGEKNFQGGKKIIPAGNFSL

SEQ ID NO: 169703 - protein, 96 aa, Heterodera glycines
  Homolog annotation: Hit_ID=XP_310184.1; Match level="QueryCoverage =100%, HitCoverage=3%, E-value=2e-41, Identity=79%"; Hit description =ENSANGP00000005472 [Anopheles gambiae]
  Gene Ontology: Mol. function=ligand-dependent thyroid hormone receptor interactor activity; Biological process=embryogenesis and morphogenesis
  Coding regions on vcDNA: vcDNA=SeqID_96126; Strand=+; Position=3-476
LISGEQSPRWTREDLLRYSEPKLGYTRDSVGFLNFVEVLMGFNSAERKAFLQFTTGCSSLPPGGLANLHPRLTVVRKVGSGDGSYPSVNTCVHYLK

SEQ ID NO: 169704 - protein, 162 aa, Heterodera glycines; identical to SEQ ID NO: 164033
  Homolog annotation: Hit_ID=NP_505165.1; Match level="QueryCoverage =55%, HitCoverage=61%, E-value=6e-10, Identity=38%"; Hit description =heat shock protein (17.6 kD) (hsp-17) [Caenorhabditis elegans] gb|AAB37035.1| Heat shock protein protein
  Coding regions on vcDNA: vcDNA=SeqID_96127; Strand=+; Position=48-536

SEQ ID NO: 169705 - protein, 163 aa, Heterodera glycines
  Homolog annotation: Hit_ID=XP_392405.1; Match level="QueryCoverage =55%, HitCoverage=41%, E-value=6e-10, Identity=36%"; Hit description =similar to CG14207-PB [Apis mellifera]
  Coding regions on vcDNA: vcDNA=SeqID_96128; Strand=+; Position=56-547
MLSPFSYDPFYRRSLWPMATHVGNVLSPFRQLERELDHFFEGMQPMLRDHVAQLNVTDKGDLTYKVDVSGFRPEEINVEVIGNEIIVNGEHREQNDSESVHRQFSRRVLIPEGIQKESIKCELDGGRLFISGMKTADKGGRTIPIEMKKKAAVDQQKEEEKQQ

SEQ ID NO: 169706 - protein, 205 aa, Heterodera glycines
  misc_feature (139)..(139): Xaa can be any naturally occurring amino acid
  Homolog annotation: Hit_ID=NP_490770.1; Match level="QueryCoverage =80%, HitCoverage=75%, E-value=6e-42, Identity=49%"; Hit description =phosphoglycerate/bisphosphoglycerate mutase (24.9 kD) (1B166) [Caenorhabditis elegans] gb|AAK21514.2| Hyp
  Coding regions on vcDNA: vcDNA=SeqID_96129; Strand=+; Position=36-650
MVKTLWIVRHAEREDNINSNWQKNANPQKLKSDNSPLSSRGIKQATELAERFSNVQIDHIFASPFERTVQTATFLISQRKIPIKVEPGLAEALYLCESPPGFEESAELRRRFPLVDSEYRSIYEKPMPREGFGDESCIXRIRQTLEEILRRYNEATSIVFVSHGSPIGRFSFKKSFFKPVKNPQIFKFFSWSCLTDATIFQIFKI

SEQ ID NO: 169707 - protein, 229 aa, Heterodera glycines
  Homolog annotation: Hit_ID=CAG04372.1; Match level="QueryCoverage =79%, HitCoverage=30%, E-value=2e-43, Identity=50%"; Hit description =unnamed protein product [Tetraodon nigroviridis]
  Gene Ontology: Mol. function=3-phosphoinositide-dependent protein kinase activity; Cellular component=plasma membrane; Biological process=signal transduction
  Coding regions on vcDNA: vcDNA=SeqID_96130; Strand=+; Position=27-713
MSSHTETMKSSSNGSDWPFCSDRMKMMQKPAKLNLNEAGPAPPSPCSVKTPLEGVSTEDTLQRLRPKEDQAEQSPTGTLATRTPKDFFFIKVLGEGSFSTVYFAKEVTTGDEYAIKVLLKSEIRREAKVRYVLREKDIMAALTYVHGGHPFVIRLYCTFQDNDRLYFALAYAKHGELLDWLRRLGSFDEAGTLFYASETFCALEFLHRCKGIHRDLKPEDILVGADWHI

SEQ ID NO: 169708 - protein, 238 aa, Heterodera glycines
  Homolog annotation: Hit_ID=CAH93155.1; Match level="QueryCoverage =91%, HitCoverage=33%, E-value=7e-94, Identity=77%"; Hit description =hypothetical protein [Pongo pygmaeus]
  Gene Ontology: Mol. function=enzyme regulator activity; Cellular component=mitochondrion; Biological process=mitochondrial translocation
  Coding regions on vcDNA: vcDNA=SeqID_96131; Strand=+; Position=7-720
MLHGWRVFASCSKSVLKSPSLQSGGYGLSRRLKSDEVRGPVIGIDLGTTNSCVAVMEGKQAKVIENAEGSRTTPSIVAFTKDNERLVGAPARRQAVTNSENTLYATKRLIGRRFDDPEVQKDIKVVPYKIVKASNGDAWLEAQGKLYSPSQIGAFVLMKMKETAESFLGTSVANSVVTVPAYFNDSQRQATKDAGKIAGLHVLRVINEPTAAALAYGLDKGEDKVIVVYDLRGGTFDI

SEQ ID NO: 169709 - protein, 254 aa, Heterodera glycines
  Coding regions on vcDNA: vcDNA=SeqID_96132; Strand=+; Position=48-809
SCPFIPAFPIKMSQFGPAFAVNANNPYAHFKCCCATFNIKDHAQFCGVLSFALFLCLVLISMMLFGSLSLFYIFVGVVVYILLMKTLFGVVNKLSLLFYIFFEAIQIGFYLALMLYIIVPLLFLEIPRRNCRNVEINSEICDEPRNRSEDYVELLLFVSLLASIKLHFARVFAHFYRYLTWNEQCSVHRAQYINGRGIHITMDQPQFAASFSPYYGWDTHTVKGCDRRGRQNETNNPNQLPITELPPTYAQVIG

SEQ ID NO: 169710 - protein, 183 aa, Heterodera glycines; identical to SEQ ID NO: 165655
  Coding regions on vcDNA: vcDNA=SeqID_96133; Strand=+; Position=34-582

SEQ ID NO: 169711 - protein, 93 aa, Heterodera glycines; identical to SEQ ID NO: 165651
  Homolog annotation: Hit_ID=NP_598458.1; Match level="QueryCoverage =94%, HitCoverage=77%, E-value=5e-09, Identity=36%"; Hit description =RIKEN cDNA 1110003E01 [Mus musculus] gb|AAH09097.1| RIKEN cDNA 1110003E01 [Mus musculus] dbj|BAC40601.1|
  Coding regions on vcDNA: vcDNA=SeqID_96134; Strand=+; Position=1-282

SEQ ID NO: 169712 - protein, 135 aa, Heterodera glycines
  Homolog annotation: Hit_ID=NP_496985.1; Match level="QueryCoverage =34%, HitCoverage=5%, E-value=2e-09, Identity=56%"; Hit description =trp-asp repeats containing protein (90.1 kD) (2O647) [Caenorhabditis elegans] emb|CAB76722.1| Hypothetical
  Coding regions on vcDNA: vcDNA=SeqID_96135; Strand=+; Position=76-480
MLVSAPLIQQQQQQQVFQQQRPSTSASSADAVLLPHATEASAPTPYQQQQTEDQLELPTSVPSAADSQRQHRATQQPQRFFKSGLGIRIIDNDLPEGPGRRLRKNVANVRKHIDYIANALNHMEARLWQSPHRRQ

SEQ ID NO: 169713 - protein, 113 aa, Heterodera glycines; identical to SEQ ID NO: 162707
  Coding regions on vcDNA: vcDNA=SeqID_96136; Strand=+; Position=25-366

SEQ ID NO: 169714 - protein, 127 aa, Heterodera glycines
  Homolog annotation: Hit_ID=NP_492133.1; Match level="QueryCoverage =97%, HitCoverage=54%, E-value=5e-39, Identity=62%"; Hit description =dual specificity phosphatase 1 (25.6 kD) (1I234) [Caenorhabditis elegans] emb|CAB01700.1| Hypothetical pr
  Gene Ontology: Mol. function=phosphoric monoester hydrolase activity; Cellular component=nucleus; Biological process=MAPKKK cascade
  Coding regions on vcDNA: vcDNA=SeqID_96137; Strand=+; Position=103-483
MAPLCFQVNEYYAQISELVPGLYICGVTGLTPANMKAFRIELIVNATREVPNLKSLGHIQRMKLWVEDTTDEDLFPHFDIVADQIHAVIQDRGAVLVHCVAGVSRSAAICLAYLLKYRTRSLRAAYH

SEQ ID NO: 169715 - protein, 75 aa, Heterodera glycines; identical to SEQ ID NO: 162913
  Coding regions on vcDNA: vcDNA=SeqID_96138; Strand=+; Position=3-230

SEQ ID NO: 169716 - protein, 93 aa, Heterodera glycines; identical to SEQ ID NO: 165645
  Coding regions on vcDNA: vcDNA=SeqID_96139; Strand=-; Position=88-369

SEQ ID NO: 169717 - protein, 130 aa, Heterodera glycines
  Coding regions on vcDNA: vcDNA=SeqID_96140; Strand=+; Position=1-393
AMMAAAAAAGAGGRMPATSTAASIGAIPTPPAGIVPPPPLPAGIPSPASGGAIPMPPQAAFAAYQDKSISGGKYGTRDEPSTSAASSSTMVKTLGAKTRIVCQDEQTSLEEMMAQRIVPTYTRGLMPFVR

SEQ ID NO: 169718 - protein, 213 aa, Heterodera glycines
  Coding regions on vcDNA: vcDNA=SeqID_96141; Strand=+; Position=78-716
PVLGPFGEHPAAAGDNDGASAPGPSPADPTHCPAAVRRPSDDALPAAPLPPVAAALLPRPFCRRFDFCCRCFFPFRSPAADAPAAICWAQRCHPSSAAQPQHRQQLHTVQPPSAAYAHSRPAVPRPNGCRLNGTNVLNGQAPSVSSCCFLSLPPPQLQAVQPPTVVDHKQTSQPHLQQSVAQFGSTIGYPHHHHVTAHQPPLSTPPPPLMLMA

SEQ ID NO: 169719 - protein, 157 aa, Heterodera glycines
  Coding regions on vcDNA: vcDNA=SeqID_96142; Strand=+; Position=3-473
QRLLPSPAAAFVPSPNGTVSVPSLPSSPTTRTTTTAMISVPAIATVTATSLASSRVPSSSSPSPVAIHPTISTKAATSSAPIILLPNKRSKEGHQSQKQTMAKEMATDFAAESKGGRESEIRRAPARQNAEDEWTKANELDEKGIPPTQRTAPKLST

SEQ ID NO: 169720 - protein, 89 aa, Heterodera glycines
  Coding regions on vcDNA: vcDNA=SeqID_96143; Strand=-; Position=1-267
MLFLFSFLSQMRIPSVCPFFYSFSVSITTAAAHWSHRPHLTHLRHFSLKQFFCVRSAEKDKRKGQNEQNNEKKMKQMGRHCQINWNNRN

SEQ ID NO: 169721 - protein, 150 aa, Heterodera glycines
  Coding regions on vcDNA: vcDNA=SeqID_96144; Strand=+; Position=27-476
HPTKGCRCRCPKRETPSRRSKCHSSPKGSKSNGRCIRRANERTLRRNAPFSFDKQSFAHKRRNTFSNRPFLSTLELLASRQTIDKPSCTSNSNLALEVSKAGIADLNRPLSRMDIFYSGSTVTLTSRIRRREATITSTNAEAGGELTASA

SEQ ID NO: 169722 - protein, 145 aa, Heterodera glycines; identical to SEQ ID NO: 162906
  Coding regions on vcDNA: vcDNA=SeqID_96145; Strand=+; Position=10-447

SEQ ID NO: 169723 - protein, 138 aa, Heterodera glycines
  Coding regions on vcDNA: vcDNA=SeqID_96146; Strand=+; Position=3-416
GYLNQLWDTVYMDLPTREFRVEEACEFMFNLLQVIRKSEEKVVRNIVSDLEIRREAVTNLWNFLGLPSFDESLFPPKSIALLKVLDSEKNRLEAKREEIVGSQARLTGKYKALCDRVGTTARQIEGVHDRIMSEDELD

SEQ ID NO: 169724 - protein, 115 aa, Heterodera glycines; identical to SEQ ID NO: 165629
  Coding regions on vcDNA: vcDNA=SeqID_96147; Strand=-; Position=39-386

SEQ ID NO: 169725 - protein, 145 aa, Heterodera glycines
  Coding regions on vcDNA: vcDNA=SeqID_96148; Strand=+; Position=20-454
MSSFPKAVNIKIEHNNSFSDHDYCYKESAVEEMDEENRSFFVDVENDDEYDDEYNARGRKRRSVKQPDFFMINNKANNSNKKTSKARPRKSESKRGKSGEKKVKYEVEYIWGKRTDKLRPDKVEYRVYWKGYPIEKSTWEPEDNL

SEQ ID NO: 169726 - protein, 150 aa, Heterodera glycines
  Homolog annotation: Hit_ID=NP_492076.1; Match level="QueryCoverage =94%, HitCoverage=34%, E-value=5e-18, Identity=36%"; Hit description =kappa B-ras (1H925) [Caenorhabditis elegans] emb|CAA96623.1| Hypothetical protein F52A8.6a [Caenorhabditi
  Coding regions on vcDNA: vcDNA=SeqID_96149; Strand=+; Position=3-452
PSAAHCQQKRRRKGKMRTKMHVVVLGPKKVGKTSLLKSLINQHDPKPSTSSSDGQLYVPTVEDTFHVQFGDFRSVDQMPQRSLLILFHDTAGITDFGSIELRKPYLQVADAFLLVYSVLDPLALSQMEALKKYLEREKNGTSKERKEVAL

SEQ ID NO: 169727 - protein, 157 aa, Heterodera glycines
  Homolog annotation: Hit_ID=NP_508280.1; Match level="QueryCoverage =100%, HitCoverage=14%, E-value=3e-74, Identity=85%"; Hit description= atp citrate lyase (XC101) [Caenorhabditis elegans] gb|AAB00585.1| Hypothetical protein D1005.1 [Caenorha
  Gene Ontology: Mol. function=ATP citrate synthase activity; Cellular component=citrate lyase complex; Biological process=ATP catabolism
  Coding regions on vcDNA: vcDNA=SeqID_96150; Strand=+; Position=3-473
VFQTVLEALEYPQIKVIAIIAEGVPENQTRKLIKVARQKGVTVIGPATVGGIKPGCFKIGNTGGMMDNILASKLYRSGSVAYVSRSGGMSNELNNIISHNTDGVFEGVAIGGDRYPGSTYTDHILRYQDDPRVKMMVLLGEVGGEEEYKIVQALKEK

SEQ ID NO: 169728 - protein, 103 aa, Heterodera glycines
  Coding regions on vcDNA: vcDNA=SeqID_96151; Strand=+; Position=3-314
SFIHSRTPPNFAPPPPSLLIYINNAVRFVHSSSVHSSPPPPPTRPHFGLALLALLSGFCLGNTFFCYTLITFIRMKTPPPPSEFLFFVIAAMPNCKTSATNKE

SEQ ID NO: 169729 - protein, 130 aa, Heterodera glycines
  Homolog annotation: Hit_ID=AAH85642.1; Match level="QueryCoverage =98%, HitCoverage=23%, E-value=9e-38, Identity=55%"; Hit description =Zgc:92133 [Danio rerio] ref|NP_001007767.1| zgc:92133 [Danio rerio]
  Gene Ontology: Mol. function=enzyme inhibitor activity; Cellular component=cytoplasm; Biological process=protein folding
  Coding regions on vcDNA: vcDNA=SeqID_96152; Strand=+; Position=84-473
MSSEQALKAKQLGNEAYKRKEFATAHKYYDEAIKYEPTNIVFYSNKAAVFFEEGKYDECIEMCGKAVEVGRENRADYALVAKAYARMANSYKMKDDPKKALHFYEKALSEHRDPDIVKKHKELAKEVKEM

SEQ ID NO: 169730 - protein, 60 aa, Heterodera glycines
  Coding regions on vcDNA: vcDNA=SeqID_96153; Strand=-; Position=1-180
RGSGRARGRHSAATATACLTLVTAVVRHLGVGLGAGDLTLVPSSLQPGGSTSCSAAATAG

SEQ ID NO: 169731 - protein, 52 aa, Heterodera glycines
  Coding regions on vcDNA: vcDNA=SeqID_96154; Strand=+; Position=11-169
KPATAPPPAKQFPPSPSPPPAQTRPTERPAKRDGRLFTGQRCDGTRGEPIAI

SEQ ID NO: 169732 - protein, 155 aa, Heterodera glycines
  Homolog annotation: Hit_ID=EAL40023.1; Match level="QueryCoverage =94%, HitCoverage=42%, E-value=6e-24, Identity=41%"; Hit description =ENSANGP00000028924 [Anopheles gambiae str. PEST]
  Gene Ontology: Biological process=cell cycle
  Coding regions on vcDNA: vcDNA=SeqID_96155; Strand=+; Position=2-469
YLSRPEKEKSHEEGENDFIRFAATSMQGWRTHQEDAHNCILSFGDECSFFAVYDGHGGSDVSSYLKKNFPDFLKEHNLLLHTIDEGLSAALHKLFVKFDETLRHDDTVKAMVELKTALSTTSDQQQQAEEQKANEGCDPGEKERKERESLIDAKK

SEQ ID NO: 169733 - protein, 130 aa, Heterodera glycines
  Homolog annotation: Hit_ID=AAT45384.1; Match level="QueryCoverage =98%, HitCoverage=30%, E-value=7e-09, Identity=31%"; Hit description =sperm nuclear basic protein PL-I isoform PLIa [Spisula solidissima]
  Coding regions on vcDNA: vcDNA=SeqID_96156; Strand=+; Position=285-677
KRARSARYEATKRPNVLKKRAQSARHEAAKRPNVPKKIKKRARSARPEAAKRPNVPQKIKKRARSARPEAAKRPNVPQKIKKRARSARTEAAKRPNIPQKIKNGREAPVLRPRSGRISPKKLKTGAKRPS

SEQ ID NO: 169734 - protein, 309 aa, Heterodera glycines
  Coding regions on vcDNA: vcDNA=SeqID_96157; Strand=+; Position=24-950
SAMAATSKLQKSGRKRLRYDSEESSDDDGIGGDGATVAIIPTPSIDLVLQNLATNALAFTAAPEMEENEEQGDAIQLFCSGSSAAEEEHHHHQQQPNGQTVSSGCSSSSRPSTDKEGEQKLRRMQAQARRQRVSKWKISETAQRKKQMQKSKGNKGVGGGGALVYSVRSSSTTANNNSISKKPPNKKKQNVADRTARKNNIGGAGGEEAPAVTKTAKTLAELLQYSNVVAANLENKLTSPTTSKNDGPPTADGFTFTAAAQEECPSSSSSKSIATLITDRFRPNRGTFYRYTPAPVVTPAVVHKLLLNA

SEQ ID NO: 169735 - protein, 90 aa, Heterodera glycines
  misc_feature (72)..(72): Xaa can be any naturally occurring amino acid
  Homolog annotation: Hit_ID=AAC47437.1; Match level="QueryCoverage =96%, HitCoverage=57%, E-value=6e-26, Identity=54%"; Hit description =COL-1
  Gene Ontology: Mol. function=structural constituent of cuticle; Cellular component=collagen; Biological process=cuticle biosynthesis (sensu Nematoda)
  Coding regions on vcDNA: vcDNA=SeqID_96158; Strand=+; Position=3-276
GGQRGNNGPPGPPGAPGAPGQPGTGGGQPEPGEPGAPGPNGQPGQAGEPGAPGRPGQRENPRPTETAPAGPXGEAGAPGQPGSGWEPRER

SEQ ID NO: 169736 - protein, 264 aa, Heterodera glycines
  Homolog annotation: Hit_ID=NP_491350.1; Match level="QueryCoverage =100%, HitCoverage=59%, E-value=4e-63, Identity=49%"; Hit description= GDP-mannose pyrophosphorylase (43.3 kD) (1E875) [Caenorhabditis elegans] gb|AAF60648.1| Hypothetical pro
  Gene Ontology: Mol. function=mannose-1-phosphate guanylyltransferase activity; Cellular component=cytoplasm; Biological process=protein modification
  Coding regions on vcDNA: vcDNA=SeqID_96159; Strand=+; Position=2-793
SRFRAVSKKVGKALFLVAGGPLIEHHISQLCEELENLHEIFIVGLYPAEEFGKFMSDGEKKYRRVPIRYIQENCPLGTAGGLLQYKDILIDRKPPDALFVLNADACGEFPFLEMVQELNQKTEAKCLILTTEATREQSVNYGSVVIDSVGLECSRGRVLHYVDKPATFVSTHISCGVYLLRGNSFDVILEQAEKTASERGLNTDSPTMQLFHSNQLWFEKDIFPQMTSDGTLFAWHTNRWWSQTKTAGAVLYANRHYLGLYRAR

SEQ ID NO: 169737 - protein, 152 aa, Heterodera glycines
  Coding regions on vcDNA: vcDNA=SeqID_96160; Strand=+; Position=174-632
THFQFDFAHFAFVWKCADNCWRNARAKNQQNVSTISDHYRMFLAINSDHYRMFLAIIITAISFAITAFPELVGKVLRFIRAGFDTHYFLDLWPYTLALISIWLYPIVYRAYKFVQQNEEHKNGGPYGQNAKVINQQYAKVVPMPLPNAEMIG

SEQ ID NO: 169738 - protein, 99 aa, Heterodera glycines; identical to SEQ ID NO: 165600
  Coding regions on vcDNA: vcDNA=SeqID_96161; Strand=-; Position=0-296

SEQ ID NO: 169739 - protein, 153 aa, Heterodera glycines
  Coding regions on vcDNA: vcDNA=SeqID_96162; Strand=+; Position=3-461
VLSSVVIGEIQQQQSPDSFVPTSFGRRRHCWVCNDVWMDILPLFDHAQLGLKLALISPRFDVLVDAHFNGKSELTIWRQITIQRFKGPKAKLSEWIDDKWVAFPLPDRPLPNKIRFRNLRIENPDHSVLAFLRANQQIFEKATNLCLSVSSCF

SEQ ID NO: 169740 - protein, 148 aa, Heterodera glycines
  Coding regions on vcDNA: vcDNA=SeqID_96163; Strand=+; Position=82-525
MSSTISENQQQSWGSFVKTSFGTRRHCWVCNDVWMDILPLFDHAQLGLKLALISPRFDVLVDAHFNGKSELTIWRQITIQRFKGPKAKLSEWIDDKWVAFPLPDRPLPNKIRFRNLRIENPDHSVLAFLRANQQIFEKATNLCLSVSS

SEQ ID NO: 169741 - protein, 438 aa, Heterodera glycines
  Homolog annotation: Hit_ID=CAE62915.1; Match level="QueryCoverage =99%, HitCoverage=44%, E-value=3e-38, Identity=27%"; Hit description =Hypothetical protein CBG07108 [Caenorhabditis briggsae]
  Coding regions on vcDNA: vcDNA=SeqID_96164; Strand=+; Position=3-1316
LFKSLGKSLHRVNGYISNKSGFVDAWKLAKETLELWTEIQSSTLRNLNDLLKEVARYQEELARMRKRAKDADTLETINLMLTTTTCLQKARDTFNQRSTEVVSLKQSNKEWTAASTKEYLRARNKLNKAHEEYKQYMDKYSQIRDTFEERVNQAARSFQEHDRLHLLQMKSFFTQMAKCLENAHGANAQVSATLRQRVEQNINVEQMMFRFIEEKGTGTEPPQKLQWTNADELPPELDVVSCVQSQSSSSNSSAIVPNFSGNQLQSNANHLLGLNDSWLTVGGGKSIAAGGGESANSGGSFDGGFGESMCSLGVKRGSINGCSEQNKSAGESDSERHLELPFSANPSSSVLSNFSAQNPSSSYVPQQISSWLGRQKFSGRLKKHFSTSQSNLAGPMAIEPFAVGESDQQTKDELIGSASNFSKSCNDPSIKTNSSAGL

SEQ ID NO: 169742 - protein, 138 aa, Heterodera glycines
  Homolog annotation: Hit_ID=CAE71824.1; Match level="QueryCoverage =85%, HitCoverage=31%, E-value=1e-28, Identity=52%"; Hit description =Hypothetical protein CBG18863 [Caenorhabditis briggsae]
  Gene Ontology: Mol. function=adenosylmethionine decarboxylase activity; Biological process=spermidine biosynthesis
  Coding regions on vcDNA: vcDNA=SeqID_96165; Strand=-; Position=42-643
ITFSVSHYQRSGILSLLPRGTIVQDELFEPVGYSMNGVPAGDEYVTIHVTPEPEFCYASFETNHRRGCLYEQTLRVLDCFRQPGRFILTLFANEHSNGAIEVQQRLWAEDFPGYRRLSVQMLRLQANWGGGEGEKSFN

SEQ ID NO: 169743 - protein, 125 aa, Heterodera glycines; identical to SEQ ID NO: 165596
  Coding regions on vcDNA: vcDNA=SeqID_96166; Strand=+; Position=7-384

SEQ ID NO: 169744 - protein, 127 aa, Heterodera glycines
  Homolog annotation: Hit_ID=CAE56085.1; Match level="QueryCoverage =96%, HitCoverage=23%, E-value=1e-40, Identity=54%"; Hit description =Hypothetical protein CBG23668 [Caenorhabditis briggsae]
  Gene Ontology: Mol. function=phospholipase C activity; Cellular component=integral to plasma membrane; Biological process =sphingomyelin metabolism
  Coding regions on vcDNA: vcDNA=SeqID_96167; Strand=+; Position=102-482
MQCAYRFNVATLNCWLLPHPWPIGSKHKQFRLQKLIDELKNSRFDVIALQEVWSEKIFLQIAHELNGFFPHSHYFHSGFTGSGTCVISKHPIVSTLLHRYSLNGFPHHVHRGDWFGGKIVGMVEIMV

SEQ ID NO: 169745 - protein, 326 aa, Heterodera glycines
  Homolog annotation: Hit_ID=CAE60606.1; Match level="QueryCoverage =96%, HitCoverage=65%, E-value=2e-63, Identity=43%"; Hit description =Hypothetical protein CBG04246 [Caenorhabditis briggsae]
  Gene Ontology: Cellular component=endoplasmic reticulum; Biological process=signal transduction
  Coding regions on vcDNA: vcDNA=SeqID_96168; Strand=+; Position=81-1058
MSDSIPRAVELFMEKKRARISKFLYTYNGNLQLNLPQLHAFACSTGGLIDDEFRERIWPILAKNLPQAKRCKDTQWDALRSEEYNDQTNHSSDELQQQQQTLFLSDSDFESALSTFTPSISGCDDQLMDAEDDAEGDDDQRMAPQNATVFDFSPDQLRAHKEWNQVELDVARTLARFPPNIDEDERACLQNELTPLIVRILCENEDFRYYQGFHDVCLTFLLVLGADSALQVMRDICARGAFHNYLCCSLEESAMRELQDLYVLLFLHDQEVEKRLRSAELGTLFALSWPLTWFSHALQNYSQVVLFFHLFLSSHPLMPIYGSGRV

SEQ ID NO: 169746 - protein, 129 aa, Heterodera glycines
  Homolog annotation: Hit_ID=CAE68127.1; Match level="QueryCoverage =89%, HitCoverage=24%, E-value=1e-19, Identity=43%"; Hit description =Hypothetical protein CBG13772 [Caenorhabditis briggsae]
  Coding regions on vcDNA: vcDNA=SeqID_96169; Strand=+; Position=66-452
MPSLSDSPPNIDPEKGFQLSAGVGHSKHSSTPNGRVRDVDELAEEVPGESDVSDEEDAESPLPSVHAQMGLFCHTNPEVAPASMWTSKNVQEFKDNIKKEGTEGVLKIGHGETVTVRVPTHPEGNSLVW

SEQ ID NO: 169747 - protein, 156 aa, Heterodera glycines
  misc_feature (116)..(116): Xaa can be any naturally occurring amino acid
  Homolog annotation: Hit_ID=P90682; Match level="QueryCoverage=100%, HitCoverage=28%, E-value=2e-69, Identity=78%"; Hit description =Catalase emb|CAA71618.1| catalase [Ascaris suum]
  Gene Ontology: Mol. function=peroxidase activity; Cellular component =cytoplasm; Biological process=determination of adult life span
  Coding regions on vcDNA: vcDNA=SeqID_96170; Strand=+; Position=2-486
SNGSPIHNKNAVLSVGPHGPMLMQDVVYLDEIAHFDRERIPERVVHAKGAGAHGYFEVTSKDMAEHCKAAMFSEIGKRTPLFFRFSHKGGESGSADTARDPRGFAIKFYTEEGNWXLVANNTPIFFIRDPFLFPNFIHSQKRNPATHLKDPEMMWD

SEQ ID NO: 169748 - protein, 153 aa, Heterodera glycines
  misc_feature (45)..(45): Xaa can be any naturally occurring amino acid
  misc_feature (56)..(56): Xaa can be any naturally occurring amino acid
  Homolog annotation: Hit_ID=AAB59522.1; Match level="QueryCoverage =98%, HitCoverage=32%, E-value=1e-68, Identity=80%"; Hit description =catalase
  Gene Ontology: Mol. function=peroxidase activity; Cellular component =cytoplasm; Biological process=determination of adult life span
  Coding regions on vcDNA: vcDNA=SeqID_96171; Strand=+; Position=2-475
FSEIGKRTPLFIRFSRVRGESGSADTARDPRGFAIKFYTEEGNWXLVANNTPASQXIFFIRDPFLFPNFIHSQKRNPATHLKDPEMMWDFWTLRPESLHQVMFLFSDRGIPDGFRFMNGYGSHTFKLVNKTGEAVYCKFHIKTRQGIKNLSPQ

SEQ ID NO: 169749 - protein, 262 aa, Heterodera glycines
  misc_feature (119)..(119): Xaa can be any naturally occurring amino acid
  Homolog annotation: Hit_ID=CAF93222.1; Match level="QueryCoverage =97%, HitCoverage=91%, E-value=1e-25, Identity=35%"; Hit description =unnamed protein product [Tetraodon nigroviridis]
  Gene Ontology: Mol. function=galactose binding lectin; Cellular component=extracellular space; Biological process=cell adhesion
  Coding regions on vcDNA: vcDNA=SeqID_96172; Strand=+; Position=65-851
MLSEIPLPHQKGIVDPRLPCKIQIVGRANDVAKRFEVNLLSQTGEHLLHFNPRFDEHCVVRSSTKDGQWQAEERGGTNPFVAGQPFSLDLLVEQGLIECSVNGFQFCEFAARDDFSQLXAVSVGGDIQLNSLEVSTAEGPAIAHEGGDKGPREADEENAQEQPPIVMPAHPEPQPVPAEPTPQQPQPPPAQGPLSVPYQAPLHALLQTNRMRVVGVPRPGAQRFTVNFKTHDGETLFHFNARFDQNCVVRNASVNRQYAPEG

SEQ ID NO: 169750 - protein, 302 aa, Heterodera glycines
  Coding regions on vcDNA: vcDNA=SeqID_96173; Strand=+; Position=39-944
MDAEKSALNETVPTESTANLTTMEQTVPKVKEVKPRRSLLAQASQQRPPLPRASAQSSASAPTQVALPRSHSRSRITPSARPVLSSRENTSIALKGTAPMSGMTRRSMTTKSQSVEHVAVAQKHLSGIGRNIANGRTKESKSANASDRQRKEVEDELNRTKQMLKQTTKTLDVFAVVASHFDRKLDNANTESAVLMAQKGDEAAQHQRAIAELDCNWKKRLQRAKEDHRVEFDELRAKISSEQAENITKIQLQHQKTVNELEKHVQKLGKKLAEQEEKHRRELGESASQSTNRLHKELESRN

SEQ ID NO: 169751 - protein, 171 aa, Heterodera glycines; identical to SEQ ID NO: 162333
  Homolog annotation: Hit_ID=CAD38524.1; Match level="QueryCoverage =98%, HitCoverage=96%, E-value=2e-62, Identity=67%"; Hit description =putative glutathione peroxidase [Globodera rostochiensis]
  Gene Ontology: Mol. function=electron transporter activity; Cellular component=mitochondrion; Biological process=phospholipid metabolism
  Coding regions on vcDNA: vcDNA=SeqID_96174; Strand=+; Position=41-556

SEQ ID NO: 169752 - protein, 123 aa, Heterodera glycines
  misc_feature (60)..(60): Xaa can be any naturally occurring amino acid
  Coding regions on vcDNA: vcDNA=SeqID_96175; Strand=-; Position=23-394
NGNVSPAQLNVACRPLLVVEGDVHFPLLLLLLHHLQFVVIAARCEIRRVHRNVALTLVDXVRRQYFLLANAQKPSELDTIEGSAKCRADIQNGRFTGTDQSFRYSHWPSVTEGDKFLLLFCPL

SEQ ID NO: 169753 - protein, 62 aa, Heterodera glycines
  Coding regions on vcDNA: vcDNA=SeqID_96176; Strand=+; Position=37-225
IAKIFNNKKNGIQFEYCNLINAGYRTNARGAWVGTLSSSTRWLGYCIVVIMVVEGVQLGTNS

SEQ ID NO: 169754 - protein, 147 aa, Heterodera glycines
  Homolog annotation: Hit_ID=CAE68915.1; Match level="QueryCoverage =98%, HitCoverage=26%, E-value=2e-24, Identity=43%"; Hit description =Hypothetical protein CBG14894 [Caenorhabditis briggsae]
  Coding regions on vcDNA: vcDNA=SeqID_96177; Strand=+; Position=98-538
MSTIGVHEIFKLSQKDHQPPEKRSKLSDGSTQIVPSVATAKNGGDILEALEKSEDTSELNEIDEASVKRICFLLERKQGKNAELRIKYAEEPPKFMESEIELNNAIQEMHVIAAEPQFYDVLVEQGSVQLLLQLLSHENTDIIAAVC

SEQ ID NO: 169755 - protein, 113 aa, Heterodera glycines
  Homolog annotation: Hit_ID=CAE75494.1; Match level="QueryCoverage =82%, HitCoverage=16%, E-value=3e-34, Identity=72%"; Hit description =Hypothetical protein CBG23499 [Caenorhabditis briggsae]
  Gene Ontology: Mol. function=regulator of G-protein signaling activity; Biological process=G-protein coupled receptor protein signaling pathway
  Coding regions on vcDNA: vcDNA=SeqID_96178; Strand=+; Position=138-476
MNVQQQQPVTSAYPQQGNFAEEKQLHPNHNVYRKMELLISLMLNVDDGVPIKTVKSFLSKLPRIPSVFTGQDLVGWLLQNVDIADLGDALHLAHLLASHGYVFQIDDHVLTVK

SEQ ID NO: 169756 - protein, 115 aa, Heterodera glycines
  Homolog annotation: Hit_ID=CAE75494.1; Match level="QueryCoverage =82%, HitCoverage=17%, E-value=7e-38, Identity=73%"; Hit description =Hypothetical protein CBG23499 [Caenorhabditis briggsae]
  Gene Ontology: Mol. function=regulator of G-protein signaling activity; Biological process=G-protein coupled receptor protein signaling pathway
  Coding regions on vcDNA: vcDNA=SeqID_96179; Strand=+; Position=129-473
MNVQQQQPVTSAYPQQGNFAEEKQLHPNHNVYRKMERLISLMLNVDDGVPIKTVKSFLSKIPSVFTGQDLVGWLLQNVDIADLGDALHLAHLLASHGYVFQIDDHVLTVKNDNTY

SEQ ID NO: 169757 - protein, 219 aa, Heterodera glycines
  Homolog annotation: Hit_ID=CAE63553.1; Match level="QueryCoverage =94%, HitCoverage=33%, E-value=8e-75, Identity=66%"; Hit description =Hypothetical protein CBG08039 [Caenorhabditis briggsae]
  Gene Ontology: Mol. function=neurotransmitter:sodium symporter activity; Cellular component=integral to plasma membrane; Biological process=protein folding
  Coding regions on vcDNA: vcDNA=SeqID_96180; Strand=+; Position=262 -1402
YICTISLPPGNNRFYLFTNVEPYAEEADGVFWSTHSRDVYNEKPLKEDMITAIEVMGFVLPHPFISPFLFSNFMYLRLFPDKTPRTVENFCTHARRGYYNGHAFHRVIKSFMIQTGDPTGRGTGGQSIWGGDFEDEFHPALRHDKAFRVSMANAGPNTNGSQFFITICPAEWLDGKNTIFGQVVEGFNVVQKINQVPVYKKSGRPREEISIISISLKSV

SEQ ID NO: 169758 - protein, 116 aa, Heterodera glycines
  Coding regions on vcDNA: vcDNA=SeqID_96181; Strand=+; Position=213-560
SEMGVLMRTTKSSTLSHGLPLHHHLHHHLITHLNFFYRRPPSLPDQQSSSSDDSHPPRPPRPQRTKKNHQSSLKHGRLNQWQQRRRDLQQQQPVVRDLLAEAAAAPLPESDDDDEQ

SEQ ID NO: 169759 - protein, 135 aa, Heterodera glycines
  Homolog annotation: Hit_ID=CAE66579.1; Match level="QueryCoverage =82%, HitCoverage=14%, E-value=3e-26, Identity=58%"; Hit description =Hypothetical protein CBG11896 [Caenorhabditis briggsae]
  Gene Ontology: Mol. function=calcium ion binding; Cellular component =extracellular space; Biological process=glucose catabolism
  Coding regions on vcDNA: vcDNA=SeqID_96182; Strand=+; Position=80-484
MSASNSRKAFVPFSNALRRRKLLFGFGVGTVIGAGFYYMDKNNERRFKRDKDVYFVSNAHAATVDTKAALNKRPSGSLPTRAELLKGMRDEEFDILVIGGGATGAGVALDAQTRGLKTALVELDDFSSGTSSRST

SEQ ID NO: 169760 - protein, 180 aa, Heterodera glycines; identical to SEQ ID NO: 163878
  Homolog annotation: Hit_ID=CAE60264.1; Match level="QueryCoverage =97%, HitCoverage=98%, E-value=1e-32, Identity=47%"; Hit description =Hypothetical protein CBG03840 [Caenorhabditis briggsae]
  Coding regions on vcDNA: vcDNA=SeqID_96183; Strand=+; Position=48-590

SEQ ID NO: 169761 - protein, 36 aa, Heterodera glycines
  Coding regions on vcDNA: vcDNA=SeqID_96184; Strand=-; Position=49-159
RKNQILNYILLLIFNGICALVNSLFFIIACKTKFLI

SEQ ID NO: 169762 - protein, 216 aa, Heterodera glycines; identical to SEQ ID NO: 162634
  Coding regions on vcDNA: vcDNA=SeqID_96185; Strand=+; Position=3-650

SEQ ID NO: 169763 - protein, 183 aa, Heterodera glycines
  Coding regions on vcDNA: vcDNA=SeqID_96186; Strand=+; Position=1-549
GAPRGGGRFPIVDPPGCIPLLRANNANVRPQLQGVDNAKDCLTPSTTGNNQPTREQPKLMDIDERIGMDDEDNDDGDRFGEAAEVLGGGDNANRVGGERVVGNRLRKRRSVSCEPTANSPAKMAPHQPADDQSAGCLLQRTQSVNAFAVPSAHQQNAVVPIASSSRISSRMPSSVSICSYANS

SEQ ID NO: 169764 - protein, 160 aa, Heterodera glycines
  Coding regions on vcDNA: vcDNA=SeqID_96187; Strand=+; Position=2-481
LPSASSFSHNHFPSSSSSTSMPKFPVPFLANSLKISSPVCADVTPTEKKATTIREVRTQKQQIKKEEKSEAQIAQEKERERVKREKEREKRRTKLSDAFSALRSSIPTLDYKTPFSDKMDCVKRLLPFGLYSETELSDDFLQKFDGELQRHSEFLCERMD

SEQ ID NO: 169765 - protein, 169 aa, Heterodera glycines
  Homolog annotation: Hit_ID=NP_500192.1; Match level="QueryCoverage =53%, HitCoverage=33%, E-value=7e-09, Identity=34%"; Hit description =paraplegin (4D100) [Caenorhabditis elegans]
  Coding regions on vcDNA: vcDNA=SeqID_96188; Strand=+; Position=1-507
KQRSDSLLLPNDPNSYLAVLNQVTWSDFIERIVPTGTVSNVHLKVSRGPERRISKKALVTVMPGARWPDGKMLPRMFFVNVPDIGRVEQEIRKAEVDAGLAPEHWSNIQWMQPGPMSLIIPSLVIFALFVLPLVFLGRMMTGSKMGNFSESISSMMGHRLRIYDPALKD

SEQ ID NO: 169766 - protein, 182 aa, Heterodera glycines
  Coding regions on vcDNA: vcDNA=SeqID_96189; Strand=+; Position=21-566
NQILNMSSLSEEVKKVKQAANIPPPAVCNRFVEGFSSVYVFETRPSSHGGAFAFRYDVEMVQLTRNKSLTSGGGDDGKNGLLRGVCFELIKFVHDSTQGFGQAAQFVYDNRKILFTNKRIEQFVLEIDTEKVQGIVRDFLRGSSVKIEIKPCQTDKHELDLNDVFSSISRRPDEQSDRSLRT

SEQ ID NO: 169767 - protein, 104 aa, Heterodera glycines; identical to SEQ ID NO: 162636
  Homolog annotation: Hit_ID=NP_872102.1; Match level="QueryCoverage =78%, HitCoverage=12%, E-value=3e-09, Identity=40%"; Hit description =putative membrane protein, family 8 (4N121) [Caenorhabditis elegans] emb|CAD56618.1| Hypothetical protein
  Coding regions on vcDNA: vcDNA=SeqID_96190; Strand=-; Position=138-452

SEQ ID NO: 169768 - protein, 344 aa, Heterodera glycines
  misc_feature (126)..(126): Xaa can be any naturally occurring amino acid
  Homolog annotation: Hit_ID=CAE71936.1; Match level="QueryCoverage =68%, HitCoverage=64%, E-value=1e-19, Identity=28%"; Hit description =Hypothetical protein CBG19000 [Caenorhabditis briggsae]
  Coding regions on vcDNA: vcDNA=SeqID_96191; Strand=+; Position=74-1106
MCHIETYIFMDFETTGLFDDGHNNPLTNPNRSNETARERAQRLDNLIKSDGNRFPKITEMAYMSVPRVLFLEGTEQMSARHLSSMSQDGEEGIEPVQVVTNVHVRQLNPQLNDKERFNYEELQRKXQEWPGVVHLLQTVPKPACLVAHNGLNFDFRILCHELRKSDLFRTHPIPEQVYFLDTLSCFYELEKEYNREIELTMENVDWTLVLSQFQPNSETVVATAEIEETVQQNGTASEGTQNSNGHKSTTVLHRLFDQKCSLTSNANGLPNSHKKINPILRHWSLALPLIMFMRKTHWSPAKRRCIDAKFFESNNRGEWNFNGNHARRLLCGRGNFKLENMFKR

SEQ ID NO: 169769 - protein, 130 aa, Heterodera glycines
  Homolog annotation: Hit_ID=NP_498148.1; Match level="QueryCoverage =54%, HitCoverage=10%, E-value=2e-12, Identity=49%"; Hit description =i-45 protein (3G466) [Caenorhabditis elegans]
  Coding regions on vcDNA: vcDNA=SeqID_96192; Strand=+; Position=268-657
CDIGTFASNRIFLTLRLQRTLPRKDTRSQTSTQSKCSRRSTSSRSNVKLGKARLTKSSQIKVPINEEEMMRFPGMEEGSQKSDKISVHRRFWQLNCKGVHFSGLPTWLQDNEFLHFGHRPPLPSFGSCFN

SEQ ID NO: 169770 - protein, 390 aa, Heterodera glycines
  misc_feature (112)..(112): Xaa can be any naturally occurring amino acid
  Homolog annotation: Hit_ID=NP_500379.1; Match level="QueryCoverage =93%, HitCoverage=65%, E-value=5e-82, Identity=44%"; Hit description =protein from EUROIMAGE 1967720 (62.7 kD) (4E360) [Caenorhabditis elegans] gb|AAD12825.1| Hypothetical pro
  Gene Ontology: Mol. function=tRNA dihydrouridine synthase activity; Cellular component=mitochondrion; Biological process=tRNA modification
  Coding regions on vcDNA: vcDNA=SeqID_96193; Strand=+; Position=3-1171
FVGCAHIKSEYVVLPIETQQQEGGNKPPNESNPLEGNSHEGILPRNVRARGMDRQREQKMAKARAENRQKIVRICPSVLFESEGRKCKYGEKCDAEHSLTKYWAKKPPDIGXVLAPNAKHHLSLEGPSCFLFDQMGKCSFSLSCCFARAHTNESDLSQKSKAGHSEWQSVLNTHTLPIQQQLRKRTYDFSRSERALHESPSGCMEREAPKWDMRTLRGKKYLAPLTTVGNLPFRRLCVELGAEVTCGEMAIATHLLQGLPSELSLMKRHPSEKIFGVQLAGGYPDSLGKAVQLITDNFNVDFIDLNLGCPLDSVNEKGAGCSLANKSNKLVSVLQCMQKSATGVPVSVKMRYGVKEGERTAHYTMGTIAERSPPQLLTLHPRSRGQRYTR

SEQ ID NO: 169771 - protein, 45 aa, Heterodera glycines; identical to SEQ ID NO: 132754
  Coding regions on vcDNA: vcDNA=SeqID_96194; Strand=-; Position=128-265

SEQ ID NO: 169772 - protein, 158 aa, Heterodera glycines
  Coding regions on vcDNA: vcDNA=SeqID_96195; Strand=+; Position=3-476
DLLHVKLLSVIAIQFFPYLQINTNITTSGTLNEGSGGGTGTAAPGQNNTNGDITGGSSAAAAVAGNVHRCQSPIMEAEVAEDTSNKMFPSHEQSQQLQQQPQGVKKESVGSSNSTTSSTRVASVVHPIETTKDSKPKPSVKDNTTISPQALNSMLSGS

SEQ ID NO: 169773 - protein, 49 aa, Heterodera glycines
  Coding regions on vcDNA: vcDNA=SeqID_96196; Strand=-; Position=233-382
EWDKIGNQNCSTNSTKLLIPTSLSSSAFCARFFRETQTESRDLASATLS

SEQ ID NO: 169774 - protein, 206 aa, Heterodera glycines
  Homolog annotation: Hit_ID=NP_741157.1; Match level="QueryCoverage =100%, HitCoverage=99%, E-value=1e-109, Identity=98%"; Hit description=ribosomal Protein, Large subunit, ubiquitin (94.0 kD) (ubq-1) [Caenorhabditis elegans] gb|AAC46525.1| U
  Coding regions on vcDNA: vcDNA=SeqID_96197; Strand=+; Position=33-650
MQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGR

SEQ ID NO: 169775 - protein, 146 aa, Heterodera glycines
  Homolog annotation: Hit_ID=AAR28027.1; Match level="QueryCoverage =76%, HitCoverage=55%, E-value=2e-09, Identity=36%"; Hit description =TBP1 [Arabidopsis thaliana] gb|AAK15570.1| putative TATA sequence -binding transcription initiation factor
  Coding regions on vcDNA: vcDNA=SeqID_96198; Strand=-; Position=36-476
MCSISNCTVVFKINVEPLTRKQFLAIAQRGSNTEYNPRRFHAIIMRIRTTMGKTVAALVFQSARVVLTGVPHPSSVNKMAARVFRRIQHTQSITLCIHQLRVVNIVGVQTFPKRISVERLQNTLGGIYDPTIFPALRCKLSNGVKA

SEQ ID NO: 169776 - protein, 137 aa, Heterodera glycines
  Homolog annotation: Hit_ID=CAE58428.1; Match level="QueryCoverage =97%, HitCoverage=22%, E-value=7e-49, Identity=67%"; Hit description =Hypothetical protein CBG01560 [Caenorhabditis briggsae]
  Gene Ontology: Mol. function=protein tyrosine kinase activity; Cellular component=filopodium; Biological process=regulation of cell cycle
  Coding regions on vcDNA: vcDNA=SeqID_96199; Strand=+; Position=2-412
CHAKRILHRDLKPQNLLISKNGELKLADFGLARAQSVPTKSYTAEVVTLWYRPPDVLLGSTDYSTHIDMWGVGCILFEMLARKPMFPGNKVEDQLDLIYRKLGTPTPQLHPRLCALPAFNCHPRHLRRHSPRALVCL

SEQ ID NO: 169777 - protein, 24 aa, Heterodera glycines
  Coding regions on vcDNA: vcDNA=SeqID_96200; Strand=-; Position=0-71
TAKLVPTVAFSCLALSNNLTIFET

SEQ ID NO: 169778 - protein, 43 aa, Heterodera glycines
  Coding regions on vcDNA: vcDNA=SeqID_96201; Strand=-; Position=3-131
ILSLKYFQKFSWRRRLPPLHKKFFFGKSAPQKSVLLIFKFGIK

SEQ ID NO: 169779 - protein, 61 aa, Heterodera glycines
  Coding regions on vcDNA: vcDNA=SeqID_96202; Strand=-; Position=95-280
ILYNRCYCVYLTDQSPPLLHPLVFHFDHQMDTFRFLSPSLSIHKRHTLSSALIVLLHINCE

SEQ ID NO: 169780 - protein, 139 aa, Heterodera glycines
  Coding regions on vcDNA: vcDNA=SeqID_96203; Strand=+; Position=64-480
SQPFFPCIHSIFWTRNSVFRKLTSRPWSTNLPFPQQTFLTQQNLGLALHCSTLIKTNEFCLGLTCPVPTEYTREPKNKTFFVCPFWRIENVQSPRSPFTNTAPPPQSQISRINQFHSRLVSQINNSLPTPRLRGRRTGR

SEQ ID NO: 169781 - protein, 70 aa, Heterodera glycines
  Coding regions on vcDNA: vcDNA=SeqID_96204; Strand=+; Position=194-406
VKPAKRLSNLIPHKLTFTESILNVKKYIKFIQFDNPWHENWDKNDCQMMRNNKKHHFQISCILSGAIVVR

SEQ ID NO: 169782 - protein, 209 aa, Heterodera glycines; identical to SEQ ID NO: 162875
  Homolog annotation: Hit_ID=XP_319335.1; Match level="QueryCoverage =100%, HitCoverage=28%, E-value=3e-37, Identity=40%"; Hit description= ENSANGP00000006147 [Anopheles gambiae]
  Gene Ontology: Mol. function=carnitine O-palmitoyltransferase activity; Cellular component=mitochondrion; Biological process=fatty acid beta-oxidation
  Coding regions on vcDNA: vcDNA=SeqID_96205; Strand=+; Position=54-680

SEQ ID NO: 169783 - protein, 119 aa, Heterodera glycines; identical to SEQ ID NO: 165550
  Coding regions on vcDNA: vcDNA=SeqID_96206; Strand=-; Position=2-358

SEQ ID NO: 169784 - protein, 168 aa, Heterodera glycines
  Coding regions on vcDNA: vcDNA=SeqID_96207; Strand=+; Position=285-788
LPQITNCPLMPTFANKCLPLELLYEIVPFIPAENAAPNALSSCSLLHKLLLPRVIKWKEKAMDERIIELFDQFKEEMEQKLMNKLDEIKEVLSLEFNQKFDALEQKFEQKFDALEVRVGRLERGTATNTNQGKKSLNVHERLDLIFEKLGIIRVNKSRSPEPSCSNTL

SEQ ID NO: 169785 - protein, 150 aa, Heterodera glycines
  Homolog annotation: Hit_ID=EAA48249.1; Match level="QueryCoverage =73%, HitCoverage=18%, E-value=4e-11, Identity=35%"; Hit description =hypothetical protein MG10312.4 [Magnaporthe grisea 70-15] ref|XP _366092.1| hypothetical protein MG10312.4
  Coding regions on vcDNA: vcDNA=SeqID_96208; Strand=+; Position=42-491
MVKVEKQISSGTSDDPLSLVDSIIKDHFLNDLKHKQLTPVQACTLRHMLANFDCVVQSPTGTGKTLAFMLPTLQILVQKKLTGAGEGKEQPTSVSDSCRILALVVAPGRDLIVQLFHLFSPLCKKLGLSTLKLHGAGGKQKKKSPKKHMK

SEQ ID NO: 169786 - protein, 159 aa, Heterodera glycines
  Coding regions on vcDNA: vcDNA=SeqID_96209; Strand=+; Position=3-479
NLTSFENASFFSMFKIVLLYHIYSAFIYCKPLKNNCDGIHHYNFLLLLFAVLGYIPYNSLINAFFKFWVLICQIFDYLLCILFLWAEMSWLPNENLLDVFAFLSDVRLLRSVSFVCHRFWRLSELALFKFHPMVAKSVRIGWDPKNASHYFFVQSVKCA

SEQ ID NO: 169787 - protein, 82 aa, Heterodera glycines; identical to SEQ ID NO: 165540
  Coding regions on vcDNA: vcDNA=SeqID_96210; Strand=+; Position=3-251

SEQ ID NO: 169788 - protein, 66 aa, Heterodera glycines
  Coding regions on vcDNA: vcDNA=SeqID_96211; Strand=-; Position=96-296
SEPLPVLASTGGGGVQRIREADPVFSLTSYGYIPMISIQCSFSFLNLLFPQEKYDHIRWPFRRCDF

SEQ ID NO: 169789 - protein, 67 aa, Heterodera glycines; identical to SEQ ID NO: 165536
  Coding regions on vcDNA: vcDNA=SeqID_96212; Strand=-; Position=403-606

SEQ ID NO: 169790 - protein, 92 aa, Heterodera glycines
  Homolog annotation: Hit_ID=CAE60538.1; Match level="QueryCoverage =89%, HitCoverage=24%, E-value=4e-27, Identity=71%"; Hit description =Hypothetical protein CBG04165 [Caenorhabditis briggsae]
  Gene Ontology: Mol. function=fructose-bisphosphatase activity; Cellular component=cytosol; Biological process=gluconeogenesis
  Coding regions on vcDNA: vcDNA=SeqID_96213; Strand=+; Position=19-297
MPSEYGIETDSVTLQRFVLNEQKKFPDATGDLTTLLTSLLTAVKAISSAVRKAGLAQLYGVAGNVNVQGEDVKKLDVLSNEVSFEGGGHSFV

SEQ ID NO: 169791 - protein, 124 aa, Heterodera glycines
  Coding regions on vcDNA: vcDNA=SeqID_96214; Strand=+; Position=2-376
IALRSVPTPYIPPNGYSARLAHFIPFPSPSPRRVRRKFLVATTFFAYQIFAINAHLFKKYSILLKCSVFCYILRIAVHLKESVIEQISQISRKVQAVAVKIVYIKTMAIRISALGPFSKLMCFY

SEQ ID NO: 169792 - protein, 130 aa, Heterodera glycines
  Coding regions on vcDNA: vcDNA=SeqID_96215; Strand=-; Position=1-390
SRPLVRSDGMERDYLTKKGCHCLSHHLPLSPLVIDELNCLALGAPIPPGSTLLSRELLIPEGSKAAVVMQRAKTAMEWLREMANSRRYGRISTATSNGNILHKLTFAIDGSTEQFKKVAGEGISLCPSVA

SEQ ID NO: 169793 - protein, 140 aa, Heterodera glycines
  Coding regions on vcDNA: vcDNA=SeqID_96216; Strand=+; Position=1-420
VKRCIVLQELKKSTEAMEQNNEQMPSQIQLDFHVFTLPYVLPHYACLSLFDGEIHHGAIATSKQRAKISCAAVLCEVLVKMGWADVKRAKKRKNSDGEKALKKKKRKGENGQTEDVEEGNVRLSHQFLLTLHPNESLDPT

SEQ ID NO: 169794 - protein, 57 aa, Heterodera glycines
  Coding regions on vcDNA: vcDNA=SeqID_96217; Strand=+; Position=3-173
DLYNAYFCFFRGFLCLMIRRLFCANFVIFGTYFQDFRKIFFLGKNFWLINYLNYPYT

SEQ ID NO: 169795 - protein, 79 aa, Heterodera glycines; identical to SEQ ID NO: 165527
  Coding regions on vcDNA: vcDNA=SeqID_96218; Strand=-; Position=129-368

SEQ ID NO: 169796 - protein, 94 aa, Heterodera glycines
  Coding regions on vcDNA: vcDNA=SeqID_96219; Strand=-; Position=353-637
PNYILFACFSLINHLFLMAPMCNDFAFSNRYCVALCLANQNDLSLSRLQNELLGGLTAGISGHPFNHNVRSALLCTGIYVLYSHGKVGQWPTSC

SEQ ID NO: 169797 - protein, 146 aa, Heterodera glycines; identical to SEQ ID NO: 162866
  Homolog annotation: Hit_ID=CAE73105.1; Match level="QueryCoverage =93%, HitCoverage=10%, E-value=1e-30, Identity=47%"; Hit description =Hypothetical protein CBG20485 [Caenorhabditis briggsae]
  Gene Ontology: Mol. function=protein binding; Cellular component =synaptonemal complex; Biological process=transport
  Coding regions on vcDNA: vcDNA=SeqID_96220; Strand=+; Position=2-442

SEQ ID NO: 169798 - protein, 118 aa, Heterodera glycines; identical to SEQ ID NO: 164421
  Homolog annotation: Hit_ID=CAE59445.1; Match level="QueryCoverage =39%, HitCoverage=49%, E-value=7e-12, Identity=76%"; Hit description =Hypothetical protein CBG02820 [Caenorhabditis briggsae]
  Coding regions on vcDNA: vcDNA=SeqID_96221; Strand=+; Position=98-454

SEQ ID NO: 169799 - protein, 339 aa, Heterodera glycines; identical to SEQ ID NO: 162809
  Homolog annotation: Hit_ID=CAE69126.1; Match level="QueryCoverage =96%, HitCoverage=67%, E-value=1e-130, Identity=70%"; Hit description= Hypothetical protein CBG15152 [Caenorhabditis briggsae]
  Gene Ontology: Mol. function=pre-mRNA splicing factor activity; Cellular component=nucleoplasm; Biological process=mRNA processing
  Coding regions on vcDNA: vcDNA=SeqID_96222; Strand=+; Position=713 -1729

SEQ ID NO: 169800 - protein, 211 aa, Heterodera glycines
  Coding regions on vcDNA: vcDNA=SeqID_96223; Strand=+; Position=2-634
RKQTAQQWPDFSKRCRALIKQWQKVAEYRPSSSCEGSSNGGTPQLVSPALKRGLTPRAGAVTTPGKRTTPHQPQQQLRVTSTGLCPPDSRQHTGRSSSTLASSVSPVENGVPTASGSYAPLPSTVKKESPRQITATVQQQHSIHKSASVGASLSCLGGSSAAKRTGPMLNGIAEDGGTVSGGAHLASSSFYADVTKDLRAVQPSLTAPSAP

SEQ ID NO: 169801 - protein, 97 aa, Heterodera glycines
  Coding regions on vcDNA: vcDNA=SeqID_96224; Strand=+; Position=322-612
MALTPASLCCGTADVTKDLRAVQPSLTAPSAPLASNPPLTLKLKRSASGVQRLTSSLSPPSDNGIGAASTSSSAPLVAQQPLQQLSVLAARQQNVQS

SEQ ID NO: 169802 - protein, 89 aa, Heterodera glycines
  Coding regions on vcDNA: vcDNA=SeqID_96225; Strand=-; Position=191-460
FHFQTSDSANWARKDFFAALLNTLKQDFIKREFRQRTVKKKKKRGKKKVKPSDFFCLQRLLIYTLTQRNARTMGQLPLVLAYYFRVSNT

SEQ ID NO: 169803 - protein, 85 aa, Heterodera glycines
  Coding regions on vcDNA: vcDNA=SeqID_96226; Strand=+; Position=227-481
RAKIYAKCAIWRYEQFCLTLARTHSAVALSLAFSLALSTLSLSLNLSFSLSLSPLSLTLFTLSLTISRSLHFITVSLSLSILSHR

SEQ ID NO: 169804 - protein, 181 aa, Heterodera glycines
  Homolog annotation: Hit_ID=NP_505876.1; Match level="QueryCoverage =92%, HitCoverage=21%, E-value=6e-40, Identity=43%"; Hit description =zn-finger, RING and Zn-finger, B-box (5L798) [Caenorhabditis elegans] emb|CAA98481.1| Hypothetical protei
  Coding regions on vcDNA: vcDNA=SeqID_96227; Strand=+; Position=7-552
EIADEEEGICTDTVQQNPLDCLRCFSPIKCPVRLPCQHYFCRLCIADEKCCVICGHPIGCSELVEDKVLNYVLESSSEVTETCANCDQISQPMFFCDTCHQPLCSGCRETTHKAKIFSTHHIFELEERGRLRSRPICPQHNEPFILFCLDSKSLMCIECFNSSSLERRGHFVNIELAHKIC

SEQ ID NO: 169805 - protein, 158 aa, Heterodera glycines
  Coding regions on vcDNA: vcDNA=SeqID_96228; Strand=+; Position=1-474
RTFDEFQMASQKQLREKKCSEVEDKTNDGTEREMTNSTSNFYKLTKTDSQSSVEQNVANLERNLSSNLVVPSTSGRCANRRDEEETSNPKNAQLSEQTKCTPEQHEEKTDECPPKESNVRLTNKICKRRMNKVENVAHLNGRGGIGALGWQATLPSAR

SEQ ID NO: 169806 - protein, 205 aa, Heterodera glycines
  Coding regions on vcDNA: vcDNA=SeqID_96229; Strand=+; Position=80-694
KKNIKLPNGGSSARKCADCQFVFPNDGCYNFFLANNPPAPMDGRGQRQRQPICQWRRVCRACGRIAYVATHQCPRDQPADDGICRRCNGPHTVDEPCYIQPIDDGSVRQRASIAVDNDDNSDDNGDDDGEDDVLPLRLCFFDAETSQDSPLQLNNRLVQKHVPLLIIAEVICERCLQVGISVNDGLGRRAPGCVCMTGMVRGQLF

SEQ ID NO: 169807 - protein, 252 aa, Heterodera glycines
  Homolog annotation: Hit_ID=XP_314537.1; Match level="QueryCoverage =92%, HitCoverage=88%, E-value=1e-39, Identity=36%"; Hit description =ENSANGP00000016990 [Anopheles gambiae]
  Coding regions on vcDNA: vcDNA=SeqID_96230; Strand=+; Position=49-804
MPSSSGSEKGNGRNGVRGEEEVKGGKEIASKTLNIQSKRFYLDVKQNDRGRFVKLAEVAMNGRKNRLFMSMRICKNIKELLGKFEGHVPASEEVNGKAENVTIQSESIVTERRRYYIDLRENRRGSFLRITQLETHSGIRNSVALPFEGIGQLHDALDSILEEYGEGFIEEEAELPHSQMIRTDGKSFFFDPGHNSRGDFLKITELKSFMGVRNSVVLSIRAIPQFTQVLSKLYDDFQELRAVEEVNVNNVL

SEQ ID NO: 169808 - protein, 273 aa, Heterodera glycines
  misc_feature (260)..(261): Xaa can be any naturally occurring amino acid
  Homolog annotation: Hit_ID=CAE74243.1; Match level="QueryCoverage =94%, HitCoverage=39%, E-value=5e-33, Identity=35%"; Hit description =Hypothetical protein CBG21928 [Caenorhabditis briggsae]
  Gene Ontology: Cellular component=nucleus
  Coding regions on vcDNA: vcDNA=SeqID_96231; Strand=+; Position=50-869
MSYDPYLSGTSSNARRLLGAPPSLSRDVITKSFVKMDCSHEASLGTECSGEESEAAKTADETEGELKPSQRDEEEENGTTGKRQQKRRKRRIRLTDIGPKAKKKAERREKPMAEKKNEVQDETNPTETHCQSSKMSPPLLEIENELGQNPPNKVKPSPHFFTPFQLLCDNLIRKFMAKDPEKYFAQPVTELEAPGYHSIVDYPMSFSTINDKIDNNMYLNLDQFKSDICLVSDNAMLYNNTGSVYFLAAQKLKVLAKYYXXEKYLLFLVYSLP

SEQ ID NO: 169809 - protein, 207 aa, Heterodera glycines
  Coding regions on vcDNA: vcDNA=SeqID_96232; Strand=+; Position=22-642
MNSQQLDDLNSCLNQLLRTIKEDTSEFPPSDLLDEIKQCLDFLANSPKILAKQRAEYISLSWPADLRVVLNRLLRTFNIPEEYVKLCFELSNCAAQSLGADWLKSSDKQFLRLLASLSSCRLRILLDKPEEIDMAQLIACHQLQEYFCGCVEDEQSWMSDDDATFVSKCCQEAAALCLFLHSRLCPSIVRHHFANGSFLCPLSFHLC

SEQ ID NO: 169810 - protein, 135 aa, Heterodera glycines
  Homolog annotation: Hit_ID=CAE64728.1; Match level="QueryCoverage =82%, HitCoverage=11%, E-value=1e-19, Identity=45%"; Hit description =Hypothetical protein CBG09515 [Caenorhabditis briggsae]
  Gene Ontology: Mol. function=aminopeptidase activity; Cellular component=cytosol; Biological process=pathogenesis
  Coding regions on vcDNA: vcDNA=SeqID_96233; Strand=+; Position=134-538
MAYELKRTDNLATGDEVDRTPKVIGIRVDEAREKVFFDLDGDLTLGNHYALRIPYSGPIASKLSGLYLTTYTTLSGEHKCAAVTQMEPTDARRMVPSFDEPEFKAIFRLSVTHPKGSRAVSNAKELREQQQTEET

SEQ ID NO: 169811 - protein, 47 aa, Heterodera glycines
  Coding regions on vcDNA: vcDNA=SeqID_96234; Strand=+; Position=35-178
FKLGDCNYRQLKLFLYFKSLIWCPNFLLTFIYNFAYNNSLNKCLDNL

SEQ ID NO: 169812 - protein, 80 aa, Heterodera glycines
  Coding regions on vcDNA: vcDNA=SeqID_96235; Strand=-; Position=393-635
MTTIIFNKGTVLAFFGFIFGFINFHVKVLNQIIHLSIQKLTMPLFDQFPPSVIENNFIGWNLNIQLSETLEKLLMVQVYI

SEQ ID NO: 169813 - protein, 158 aa, Heterodera glycines
  Homolog annotation: Hit_ID=AAM54703.1; Match level="QueryCoverage =100%, HitCoverage=35%, E-value=6e-27, Identity=39%"; Hit description= vasa-like [Sparus aurata]
  Gene Ontology: Mol. function=RNA binding; Cellular component =cytoplasm; Biological process=pole plasm RNA localization
  Coding regions on vcDNA: vcDNA=SeqID_96236; Strand=+; Position=2-475
TFDITVQNTASNFLRNNYIFITVGKLNSAVETIDQQFIEVQKYSKQDKLLEMLKTDAIWRPRPNEDPFLKPAKKTLIFVETKRNSDRLAIALTQEKFYNTQSLNSDRTLEQRHLAVRKFIQGQYDILVSTDVAARGINIPNVEHVINYDLPEKEIDTY

SEQ ID NO: 169814 - protein, 51 aa, Heterodera glycines; identical to SEQ ID NO: 165510
  Coding regions on vcDNA: vcDNA=SeqID_96237; Strand=+; Position=174-329

SEQ ID NO: 169815 - protein, 302 aa, Heterodera glycines
  Homolog annotation: Hit_ID=AAC48327.1; Match level="QueryCoverage =100%, HitCoverage=63%, E-value=1e-177, Identity=100%"; Hit description=beta-1,4-endoglucanase-1 precursor [Heterodera glycines] gb|AAC15707.1| beta-1,4-endoglucanase-1 precur
  Coding regions on vcDNA: vcDNA=SeqID_96238; Strand=+; Position=5-910
MCRLQATHLLARLFLLLALCTALVSSLTAVAPPFGQLSVSGTNLVGANGQPVQLIGNSLFWHQWYPQFWNADTVKALKCNWNANVIRGAMGVDEGGYLSDANTAYNLMVAVIEAAISNGIYVIVDWHAHNSHPDEAVKFFTRIAQAYGSYPHILYEDFNEPLSVSWTDVLVPYHKKVIAAIRAIDKKNVIILGTPTWSQDVDVASQNPIKDYQNLMYTLHFYASSHFTNDLGAKLKTAVNNGLPVFVTEYGTCEASGNGNLNTDSMSSWWTLLDSLKISYANWAISDKSEACSALSPGTTAA

SEQ ID NO: 169816 - protein, 141 aa, Heterodera glycines; identical to SEQ ID NO: 162855
  misc_feature (48)..(48): Xaa can be any naturally occurring amino acid
  misc_feature (91)..(91): Xaa can be any naturally occurring amino acid
  Homolog annotation: Hit_ID=AAH84352.1; Match level="QueryCoverage =100%, HitCoverage=18%, E-value=1e-22, Identity=41%"; Hit description= Unknown (protein for IMAGE:5078020) [Xenopus laevis]
  Gene Ontology: Mol. function=DNA binding; Cellular component=nucleus; Biological process=regulation of transcription, DNA-dependent
  Coding regions on vcDNA: vcDNA=SeqID_96239; Strand=-; Position=2-426

SEQ ID NO: 169817 - protein, 147 aa, Heterodera glycines; identical to SEQ ID NO: 162853
  Homolog annotation: Hit_ID=BAB10116.1; Match level="QueryCoverage =67%, HitCoverage=32%, E-value=1e-10, Identity=35%"; Hit description =late embryogenesis abundant protein-like [Arabidopsis thaliana] ref|NP_199244.1| late embryogenesis abunda
  Coding regions on vcDNA: vcDNA=SeqID_96240; Strand=+; Position=34-477

SEQ ID NO: 169818 - protein, 291 aa, Heterodera glycines
  Coding regions on vcDNA: vcDNA=SeqID_96241; Strand=+; Position=1-873
ELIREPMFGNYYQFDGTFLESDVLEPTSVTALANDSKALLDARAKLWDEKFGNDKCTLQKIKEMGIDSLVKKIFDSSVSEEAMEENETEQKANGNVKLHVEVKRSGIKNKNGAEIYCSDNFPLVIDSSGLLNRFLEDEPIIRHAPDRKFGVWCAPRKYSIDGIQWKIVRIDPESKPKKSVPNGVSKMNGFSKECVSNGGQTDECISSSPSTVPSLPSTTVRNSPKLEEEEEKVDENELFEGLICSQNETHFLVFSPGRRWLGRLDKAKCGKDSASILGMWIQFKIKNKAGM

SEQ ID NO: 169819 - protein, 134 aa, Heterodera glycines
  Homolog annotation: Hit_ID=NP_508149.1; Match level="QueryCoverage =97%, HitCoverage=23%, E-value=8e-24, Identity=45%"; Hit description =microtubule-interacting protein that associates with TRAF3 (XB385) [Caenorhabditis elegans] gb|AAC47924.1
  Coding regions on vcDNA: vcDNA=SeqID_96242; Strand=+; Position=72-473
MGSTDQTKALFSTLIQRPTLTDQLLQRPPFKFIHDIVHETLRVTGFLDGLFTSDELDSTKAGSSRDNKMAFLQKLIDALNMDGHLDDVKPAKIVAGKEAEMTNLLLQSFASEATMYAKQDNNKQQQGDVAVKKS

SEQ ID NO: 169820 - protein, 171 aa, Heterodera glycines
  Coding regions on vcDNA: vcDNA=SeqID_96243; Strand=+; Position=3-518
AIHRDYESPFSGYIEMHEHTSAFCFTMVERDMRIFYDSGAGTPMGRYTLVLHGIVQGNYLGNDSGLGLPIFFFWFYWEGRSQTNRNGFFRSRLFLAKVQMLKVMALAWGKELLTSPIEVLLNVFFNRMDRSLTIKNLYVIIITENCLALGRCSIGSLQVSLIFLVELLQKK

SEQ ID NO: 169821 - protein, 113 aa, Heterodera glycines
  Homolog annotation: Hit_ID=CAC33829.1; Match level="QueryCoverage =99%, HitCoverage=34%, E-value=3e-37, Identity=71%"; Hit description =annexin 2 [Globodera pallida]
  Gene Ontology: Mol. function=anticoagulant activity; Cellular component=plasma membrane; Biological process=skeletal development
  Coding regions on vcDNA: vcDNA=SeqID_96244; Strand=+; Position=421-811
MMSNATKNILGTPTIVDNVSFDPKVSANFLHKAIEEKRKDEIIHLLCTISNQQRQELAREFKQLFGEDLSAKLKKALSGDFEELILALLEPPAVYDAQQMHRAMSGLGTRESV

SEQ ID NO: 169822 - protein, 227 aa, Heterodera glycines
  Coding regions on vcDNA: vcDNA=SeqID_96245; Strand=+; Position=4-687
NCKRMTENRRAAREIQRQQQKQQSLLKKIDFCSSNVFDLLDRPTVGTSLAPISAVFDAIVDAHLFGKNRYIDHTVVAFLHRIRRLFRHSAIALKMVIWPQSVRAWHVMAQQIWPLAASNVCQLSVDSYVFSRLREFVSPSVLRDCANLRQIESDGLFPEGPPDDHPHASDGQALAKWLHTPRADGRPKLLNVEAMTGQFHEQIERLKENKQEDGRNKSKTPKNNFYW

SEQ ID NO: 169823 - protein, 159 aa, Heterodera glycines
  Homolog annotation: Hit_ID=CAE65897.1; Match level="QueryCoverage =97%, HitCoverage=6%, E-value=4e-33, Identity=47%"; Hit description =Hypothetical protein CBG11064 [Caenorhabditis briggsae]
  Coding regions on vcDNA: vcDNA=SeqID_96246; Strand=+; Position=3-479
MTTVGILGGSHQWFPADQPAELICAASVSSLVERVEWKRAGGDALPSDASDEEHRGVLRFDPFKPADHAGEYECNAYRNEEVIATSKVEVHPEGDTRPDLLHVDISPPQVRMVNAGDSIVLDCVVHGRSADEFTYSWSLARGGALIRELGRQSQLLVKS

SEQ ID NO: 169824 - protein, 201 aa, Heterodera glycines
  Homolog annotation: Hit_ID=NP_506153.1; Match level="QueryCoverage =97%, HitCoverage=10%, E-value=9e-30, Identity=37%"; Hit description =TEMO (5N87) [Caenorhabditis elegans] emb|CAA98425.1| Hypothetical protein C14C10.5 [Caenorhabditis elegan
  Coding regions on vcDNA: vcDNA=SeqID_96247; Strand=+; Position=2-604
SIVDEILLILGKPNAHDQLKGALYVLTNGKEQSLLLRQDWAVLLQLWPALCLVDNSENKQSIIQLTDLARDLIVSNFSSFQIEYYLPDSVMPLAEQLLSDYPGICHKPAWPLPDKQKLGEFREREAEICGRNRENFLALAEKLLTIAKDENLHWRQVDFAETLLSLLLRKDCDLPEGVVLHFFKLLTSDIINTRKIAIGFC

SEQ ID NO: 169825 - protein, 271 aa, Heterodera glycines
  misc_feature (61)..(61): Xaa can be any naturally occurring amino acid
  Homolog annotation: Hit_ID=NP_497763.1; Match level="QueryCoverage =98%, HitCoverage=94%, E-value=5e-68, Identity=46%"; Hit description =galectin (32.4 kD) (lec-4) [Caenorhabditis elegans] emb|CAA88850.1| Hypothetical protein C44F1.3 [Caenorh
  Gene Ontology: Mol. function=lectin; Cellular component=extracellular space; Biological process=cell adhesion
  Coding regions on vcDNA: vcDNA=SeqID_96248; Strand=+; Position=63-875
MDRSILVPYTSRLMSEISPGQTLNIHGNVNADAHRFEVNLLSNCVEIDAHMGSAPLHFIVXFDEGKVVLNSFAAGEWGKEERHSNPFTKGQPFDLRFRVHEDRIEIFANQKQITEFKHRILYTNVDHIQVRGDVTLSGVHWGGRYFELPFQANFHGTSLKSGQRLFVYGIPKGNFSINLIGANGDTLFHLNPRFSEKKIVRGSQKDGVWGEEEREGAFPLKKEQAADIAVFNEPYSLQIFIHGHHYCAFAHRVEAPNTDYNLVPVEGDHGL

SEQ ID NO: 169826 - protein, 199 aa, Heterodera glycines
  Homolog annotation: Hit_ID=CAE71936.1; Match level="QueryCoverage =97%, HitCoverage=50%, E-value=5e-22, Identity=34%"; Hit description =Hypothetical protein CBG19000 [Caenorhabditis briggsae]
  Coding regions on vcDNA: vcDNA=SeqID_96249; Strand=+; Position=70-666
MCHIETYIFMDFETTGLFDDGHNNPLTNPNRSNETARERAQRLDNLIKSDGNRFPKITEMAYMSVPRVLFLEGTEQMSARHLSSMSQDGEESIEPVQVVTNVHVRQLNPQLNDKERFKYEELQRKVPSVLLKQSDLTCKCTFAQEWPGVVHLLQTVPKPACLVAHNGLNFDFRILCHELRKSDLFRTHPIPEQVYFLDT

SEQ ID NO: 169827 - protein, 170 aa, Heterodera glycines
  Homolog annotation: Hit_ID=CAE71248.1; Match level="QueryCoverage =55%, HitCoverage=44%, E-value=6e-24, Identity=58%"; Hit description =Hypothetical protein CBG18124 [Caenorhabditis briggsae]
  Gene Ontology: Mol. function=SH3/SH2 adaptor protein activity
  Coding regions on vcDNA: vcDNA=SeqID_96250; Strand=+; Position=109-618
NAWTSYKGYDKKPYCQAYYPKTVPSAVAATPEMEQAKRNTAYQSQVKYHEAYEKQMKGTKMEVADDPETMRHKANMVNQSLAHYHGELQKKEKQDSQRDTTAGSAPSVGFAVHSSPSLDSLGSAISTASSVVRPSNGSSSGNIGHVQQNIRRNSPQQHHQQQTYSYGQLF

SEQ ID NO: 169828 - protein, 154 aa, Heterodera glycines
  Coding regions on vcDNA: vcDNA=SeqID_96251; Strand=+; Position=4-468
TSGSPGCRNSARGFNNHANHFMPNFCIPPPPPPQLPQPLNSARVFFPPVPHHHHPAYYLQPQHAHPHMNPQFFNLSVPPPQITQNISSLIAANINNYPTRHPLNGTHQITTSERFSKTFHTGHANGFTSKGNGAPLSRSRKRFLEQITNEEGWI

SEQ ID NO: 169829 - protein, 155 aa, Heterodera glycines
  Homolog annotation: Hit_ID=NP_501284.1; Match level="QueryCoverage =98%, HitCoverage=64%, E-value=5e-29, Identity=49%"; Hit description =GAF domain protein like (24.2 kD) (4I546) [Caenorhabditis elegans] gb|AAK84503.1| Hypothetical protein C3
  Coding regions on vcDNA: vcDNA=SeqID_96252; Strand=+; Position=100-564
MARLSSSDVYKHDHFLHFDHLHIDNIHCARKLVVHLRPSERTLLLQALTELNAEAKTDGNGHSDHPPSPAQMKQLFFVNTIPFVGFGVLDNMIMILAGEYIDLYLGTLLCISTMAAAALGNIISDVAGGGVAHYVEQFPRHLGYKHPVLPPKQLE

SEQ ID NO: 169830 - protein, 83 aa, Heterodera glycines
  Coding regions on vcDNA: vcDNA=SeqID_96253; Strand=-; Position=1-249
FTTCRCLSPSAASSASRKESINIMCCIVKRKYYMSMYVCIMIVFCKPSLIVISRSLPFPSLISPLFSPSVLLLLLVPVCWLHS

SEQ ID NO: 169831 - protein, 47 aa, Heterodera glycines
  Coding regions on vcDNA: vcDNA=SeqID_96254; Strand=-; Position=33-176
QPEMCQEIKHWLFVKFIGTRIHNNLKFIRNFFNFKYSFSDFNNFILI

SEQ ID NO: 169832 - protein, 182 aa, Heterodera glycines
  Homolog annotation: Hit_ID=CAE68081.1; Match level="QueryCoverage =100%, HitCoverage=34%, E-value=4e-77, Identity=78%"; Hit description= Hypothetical protein CBG13714 [Caenorhabditis briggsae]
  Gene Ontology: Mol. function=nicotinic acetylcholine receptor -associated protein activity; Cellular component=membrane; Biological process=synaptic transmission, cholinergic
  Coding regions on vcDNA: vcDNA=SeqID_96255; Strand=+; Position=3-548
ETVNLYSFIPNEEWEVMSFKIHRVVEKFVCCDEPWVLLHASLVVRRKPLYYIVNLVLPTSVITLVAVTGFFTPASTSNERREKLSLGIDSLLAMSILMMMVSEQMPTTSEYVPLFGLFYLSIIVIIFSGTLITALVLNVHLQKTYNRPIPPLITFIFFHKIAPWLGIRPSTILLELWQETGV

SEQ ID NO: 169833 - protein, 105 aa, Heterodera glycines; identical to SEQ ID NO: 162844
  Coding regions on vcDNA: vcDNA=SeqID_96256; Strand=+; Position=1-318

SEQ ID NO: 169834 - protein, 147 aa, Heterodera glycines; identical to SEQ ID NO: 162842
  Coding regions on vcDNA: vcDNA=SeqID_96257; Strand=-; Position=1-441

SEQ ID NO: 169835 - protein, 188 aa, Heterodera glycines
  Coding regions on vcDNA: vcDNA=SeqID_96258; Strand=+; Position=125-688
DGQKFNLENESRAGALNSKEWMETEMPFSHSLETPQFFPIKWQFVPPPLTVSHLSTSSALCPSAFVRNCNVGQPFWSAREALVVQLREFGSVLLHVGDGFHALKFRLSLCLFYPFVCPFACLAFLQRVIVAHVSLHKPCLGRAVLAQWTLVQRDVQVVLRNVPRCLPYVQTAEAAPVEVLRDTGGQAP

SEQ ID NO: 169836 - protein, 156 aa, Heterodera glycines
  Homolog annotation: Hit_ID=NP_498662.1; Match level="QueryCoverage =91%, HitCoverage=22%, E-value=6e-43, Identity=59%"; Hit description =putative protein, with at least 8 transmembrane domains, of ancient origin (69.0 kD) (3I666) [Caenorhabdi
  Coding regions on vcDNA: vcDNA=SeqID_96259; Strand=+; Position=17-484
MDAPADAPGVHLFGTVVPKEVFLAQLFYLLYFASFGSLFPLLAVYFKQLGLSAAQAGILLGSRPLVEFVASPFWGSFADRFRKGKLLLLCSLCSMVVFTLAVGFVQPLTPYCVVLDQNSTGGECKFLVPASEIVRGGALGYIKKVAGIGRRRRGKT

SEQ ID NO: 169837 - protein, 152 aa, Heterodera glycines
  Coding regions on vcDNA: vcDNA=SeqID_96260; Strand=-; Position=90-548
DNGPLGGRHFRQTTVGGMAPIGRTGPAGGIGAMGDCPVAHTGKDSKFGCCCCWFVCCRFSRALPRIDESSEWFSSCAVHPPFGFAVVVDVPPPPCVVVVVVSLSLLPMPKMPKVPSTIRRKVKRAQKVLKFASWVILILCSLYGGLFLSFCE

SEQ ID NO: 169838 - protein, 158 aa, Heterodera glycines
  Coding regions on vcDNA: vcDNA=SeqID_96261; Strand=+; Position=1-474
VSLAPFPSMKMAIRSFLGPACCSPTGAAVLLLISGLANTVSLASIATGNGARLGIFRPTRSISYDGQQEETEYEVEPGFEKRSMTLGRLSFRPGKRWSFPVSGAYAHDRQNRRYDLLLLSEKQPSYGLAPSEVEYNVPIQAKPSVVRHINFRLLPETG

SEQ ID NO: 169839 - protein, 72 aa, Heterodera glycines; identical to SEQ ID NO: 165480
  Coding regions on vcDNA: vcDNA=SeqID_96262; Strand=+; Position=59-277

SEQ ID NO: 169840 - protein, 136 aa, Heterodera glycines
  Homolog annotation: Hit_ID=NP_497599.2; Match level="QueryCoverage =98%, HitCoverage=15%, E-value=4e-39, Identity=42%"; Hit description =myotactin, LEThal LET-805 (479.6 kD) (let-805C) [Caenorhabditis elegans] gb|AAK21414.2| Lethal protein 80
  Coding regions on vcDNA: vcDNA=SeqID_96263; Strand=+; Position=3-410
QLAHALEISFLPPYPPNGILDQYRIRWTVHGKFNYREQRVPAFELECSDSRMRGRLCYRISGLEPEQEYEIQAAAHTERGDWSDWSEPLVTKTTEQDIPVLEHPLELEFAKSTSIGVRWRGLEENLAEHITGYALE

SEQ ID NO: 169841 - protein, 71 aa, Heterodera glycines
  misc_feature (32)..(32): Xaa can be any naturally occurring amino acid
  Coding regions on vcDNA: vcDNA=SeqID_96264; Strand=+; Position=14-227
KEKLTKSYEKRNFKAKKRKKKEKHMIKKKRKXSNETKSHEKEIFKLRKEKRAKKKRKRKAIKKKINFKAKK

SEQ ID NO: 169842 - protein, 146 aa, Heterodera glycines; identical to SEQ ID NO: 165473
  Coding regions on vcDNA: vcDNA=SeqID_96265; Strand=+; Position=32-469

SEQ ID NO: 169843 - protein, 136 aa, Heterodera glycines
  Homolog annotation: Hit_ID=AAQ82687.1; Match level="QueryCoverage =95%, HitCoverage=12%, E-value=1e-09, Identity=37%"; Hit description =Epa5p [Candida glabrata]
  Coding regions on vcDNA: vcDNA=SeqID_96266; Strand=+; Position=143-550
MLLDNALKASAVNSGGEMPKRMSYSSVVMARSSSSSSASSSISSSSSTAPPPPLPKSSSASSSFSSYLSCSSSSSLAANREFVPKNKGEPKKMPKRHQQRWKRWRTVTSESAFFYRSSSSSLLSLDSATSTTTSSS

SEQ ID NO: 169844 - protein, 110 aa, Heterodera glycines
  misc_feature (21)..(21): Xaa can be any naturally occurring amino acid
  Coding regions on vcDNA: vcDNA=SeqID_96267; Strand=+; Position=151-479
WHVLPLHPPLLLPSLLLPPPXPPPPPPLPKSSSASSSFSSYSSCSSSSSLAANREFVPKNKGEPKKMPKRHQQRWKRWRTVTSESVFFYRSSSSSLLSLDSATSTTSSSN

SEQ ID NO: 169845 - protein, 47 aa, Heterodera glycines
  Homolog annotation: Hit_ID=NP_055299.1; Match level="QueryCoverage =91%, HitCoverage=9%, E-value=5e-12, Identity=74%"; Hit description =molybdenum cofactor synthesis 3 [Homo sapiens] emb|CAB53750.1| MOCS3 [Homo sapiens] gb|AAH15939.1| Molybde
  Coding regions on vcDNA: vcDNA=SeqID_96268; Strand=+; Position=1-144
DIVADCSDNVATRYLINDACVLSGKPLVYGSALGWEGQFTVYNNGTV

SEQ ID NO: 169846 - protein, 55 aa, Heterodera glycines
  Coding regions on vcDNA: vcDNA=SeqID_96269; Strand=-; Position=3-167
FVNRFSSKRPIFATKRRLFCLLKLPFFAARFFQKIGGWRGASGGAKRRRRGNFCN

SEQ ID NO: 169847 - protein, 149 aa, Heterodera glycines
  Homolog annotation: Hit_ID=XP_317885.1; Match level="QueryCoverage =95%, HitCoverage=14%, E-value=4e-32, Identity=43%"; Hit description =ENSANGP00000004923 [Anopheles gambiae]
  Gene Ontology: Mol. function=ARF guanyl-nucleotide exchange factor activity; Cellular component=mitochondrion; Biological process =endocytosis
  Coding regions on vcDNA: vcDNA=SeqID_96270; Strand=+; Position=27-473
MQMRVEWNEQQRRRLYRIALNFFNKTPDLGVQLLISWGFVRNSPRELALLFMERRGISKQMIGEYLGTLRSQFHTAVLNCFIEQISMYDMEIDIALRQLLKHIRLPLEAQKIDHIIQAFAQHYVACNRNRLCALDTPDSMYILAFAVIM

SEQ ID NO: 169848 - protein, 198 aa, Heterodera glycines; identical to SEQ ID NO: 163094
  Homolog annotation: Hit_ID=A48575; Match level="QueryCoverage=96%, HitCoverage=21%, E-value=5e-84, Identity=86%"; Hit description =paramyosin - nematode (Onchocerca volvulus)
  Gene Ontology: Mol. function=structural constituent of muscle; Cellular component=striated muscle thick filament; Biological process=striated muscle contraction
  Coding regions on vcDNA: vcDNA=SeqID_96271; Strand=+; Position=74-667

SEQ ID NO: 169849 - protein, 154 aa, Heterodera glycines
  Coding regions on vcDNA: vcDNA=SeqID_96272; Strand=+; Position=1-462
EEEERMSSSRANKFAVAFLDDEQTDETTEANSETENEENLTNESKQTKAKNEGKNKNRKGTKKQKRTKAEKAKEFGTSEQMPMATKKTMPPNETAQKSNLVDDPLERLLKVDLRSLNPDDELRRLLGRTFGAEQRRRGGQQQQQRRIGAAQLGG

SEQ ID NO: 169850 - protein, 123 aa, Heterodera glycines
  Coding regions on vcDNA: vcDNA=SeqID_96273; Strand=+; Position=1-372
KLELPAVAAASQLVDPPGCMTSARGNPPVSQRRWYEQKKKAKWIHQNVSFRTSRGLEFRAERMFSAVIQSENEYGRVGRQQTVQTVARPFVRSIFGEWPLRCHCCSSKEREPLTLTTIGKCAT

SEQ ID NO: 169851 - protein, 85 aa, Heterodera glycines
  Coding regions on vcDNA: vcDNA=SeqID_96274; Strand=+; Position=35-289
LKIKCNFGEMLCQIGTVGKNAKFLMHIFILFESGDISRLTIRPIKISAHAITVKWYAISRGCMENIPIHKYLLFYTLATDDYNWK

SEQ ID NO: 169852 - protein, 152 aa, Heterodera glycines
  Homolog annotation: Hit_ID=BAB46864.1; Match level="QueryCoverage =95%, HitCoverage=27%, E-value=1e-12, Identity=31%"; Hit description =hypothetical protein [Macaca fascicularis]
  Coding regions on vcDNA: vcDNA=SeqID_96275; Strand=+; Position=108-563
MSRSHYDKIMFPPISAHGMLTLDRSKFTKSIQIPFVSVPVKCIDRVRLLSAVRAVCLERMPRLKPWHTPPNCDGSVERLLLFDPDKFGEEATNDLAQQLSQTMDSSPEFGKMAYTMEYEDWDLRRCIQSVLPDGFEFSGFEQCGHIIHLNLR

SEQ ID NO: 169853 - protein, 62 aa, Heterodera glycines
  Coding regions on vcDNA: vcDNA=SeqID_96276; Strand=-; Position=57-245
ITTFRPSVPISRAINKLHQKLDPPTDNCTTYHNPETNHRHTFSNSDLLFVVEVTTQSIIIIY

SEQ ID NO: 169854 - protein, 88 aa, Heterodera glycines
  Homolog annotation: Hit_ID=AAG00551.1; Match level="QueryCoverage =89%, HitCoverage=26%, E-value=2e-11, Identity=48%"; Hit description =retinitis pigmentosa GTPase regulator [Homo sapiens]
  Coding regions on vcDNA: vcDNA=SeqID_96277; Strand=-; Position=126-392
SRSWSRKVRGIGKDEKEEKLEGKSADEEGEEEEKPEGNGAGEEEKPEGNGAEVDGEEEEKPDGNGAGEEEKPEGNGAEGGGVEGTNGG

SEQ ID NO: 169855 - protein, 156 aa, Heterodera glycines
  Homolog annotation: Hit_ID=NP_508039.1; Match level="QueryCoverage =88%, HitCoverage=20%, E-value=3e-30, Identity=41%"; Hit description =poly ADP-ribose Metabolism Enzyme (pme-6) [Caenorhabditis elegans] pir||T18600 hypothetical protein AC8.1
  Coding regions on vcDNA: vcDNA=SeqID_96278; Strand=+; Position=17-484
MENDYATPKEPPYGAEYAKSNRASCKGCKQLISQGELRMAVRFPSRFFDGMQENWHHFECFWKKARKNDINEASIRGMEWLKWEDQEKIRARITELKESDDSAYTPKAAVMTIEHAKSGSSKCYKCKNSIAKGDLRVSSKASFYHLECFHSLGIFQ

SEQ ID NO: 169856 - protein, 389 aa, Heterodera glycines
  Homolog annotation: Hit_ID=NP_497509.2; Match level="QueryCoverage =100%, HitCoverage=22%, E-value=6e-61, Identity=35%"; Hit description= yeast translation activator GCN1 like (3D287) [Caenorhabditis elegans] gb|AAK29920.2| Hypothetical prote
  Gene Ontology: Mol. function=translation factor activity, nucleic acid binding; Cellular component=ribosome; Biological process =regulation of translation
  Coding regions on vcDNA: vcDNA=SeqID_96279; Strand=+; Position=3-1169
MFELMLHCLSSAVVDRQQMAVRCLSELVKKMGERILEIVLPLLEDRLRQGGVNDRRGVALALNEIIGNVHREIVENHASSFIGSIRICLSDSDSSVRDAAGQAFAAYHSATSYLAVEQIVAPMLDTYNKTGEPFILDGLCSVMAGPNGRQLFQSLLPKLARSPVNSAALCRLALSTDAMKRNLNKVMEAMLNGDINTSVDEHIQNCIPVLLTLDDEDDMRAMFSLLLKFASKKESAEVASLLLRTYIDECDGMEYSESQLDTLFCGLVGLYNSDNPNVLQNAIESLVALVKQIDPSSYIQLSLLLKRAIKGLASDTRELSSDGCSRGLCVSTGWQPFLAILREALLMGGVEIKEVAANCLSQLIPLSSEAGLRPHVVNMAGPLFRILGD

SEQ ID NO: 169857 - protein, 119 aa, Heterodera glycines
  Coding regions on vcDNA: vcDNA=SeqID_96280; Strand=+; Position=37-393
MGFSKTIAFLSLLALFCATIAEENGATEGTEAEATTVPTLTAAAEGGKGGEEEVTTAKPTETSETAREEGEEKHKANEGKAIEGSGTRSLLQKVTCMLFGFFPFRAGCPGKNDIKAESS

SEQ ID NO: 169858 - protein, 91 aa, Heterodera glycines
  Coding regions on vcDNA: vcDNA=SeqID_96281; Strand=+; Position=242-514
KHHLILMKMNLFLRFNGRSDEFRQKQLTICVVYIVHVFGVAAFFVQMVPFFVHFVTFFAEFKASRNFRLPFRIPLESKFKFCPNILPRKLN

SEQ ID NO: 169859 - protein, 59 aa, Heterodera glycines
  Coding regions on vcDNA: vcDNA=SeqID_96282; Strand=+; Position=150-329
IFSRNIKFLFYYAFNYVYAFSFMTNTDIKFYLFFYLCLLPCENLVFPINKLTFFNESIY

SEQ ID NO: 169860 - protein, 76 aa, Heterodera glycines
  Coding regions on vcDNA: vcDNA=SeqID_96283; Strand=+; Position=39-269
LKIKCLIFKTGIPPIIYLAFNKTVRRDVYIMLVRPLAMVLPCITVPPELSATQNFGSNSRVAGAGTRIVSISLTVQ

SEQ ID NO: 169861 - protein, 167 aa, Heterodera glycines
  Homolog annotation: Hit_ID=CAC84452.1; Match level="QueryCoverage =99%, HitCoverage=46%, E-value=3e-60, Identity=65%"; Hit description =polyglutamate synthase [Meloidogyne artiellia]
  Coding regions on vcDNA: vcDNA=SeqID_96284; Strand=+; Position=3-506
KSAEEIARKIGKNRRPSGDVVVLSLHWGGNWGYEISKTERDFAHQLIDSGTVDILCGHSSHHPKAIEVYKGKLILYGCGDFLNDYEGISGHNEFHDELTLMYFPVVDGKNGIIIRLDAVPMKINKMRLNRANAEDSLWLYRTMARECAKFGVRVQRDEKTNVLSFLW

SEQ ID NO: 169862 - protein, 160 aa, Heterodera glycines
  Coding regions on vcDNA: vcDNA=SeqID_96285; Strand=+; Position=2-481
NHWPTMGQSQGIPQSPPEGPSQENNGRTAQPNGATDEGIFRVKVSNCPNTSPRNLRQTFQMQHNRRQSRSKSLEPNAALDIRTIGHRKSSRFGTKTELKKRGQNQNLWNPEKAATQIIGQQLQNPHTQPPTIQLQTVSIHLKQFRNQNGKTDLLEDNKKD

SEQ ID NO: 169863 - protein, 64 aa, Heterodera glycines
  Coding regions on vcDNA: vcDNA=SeqID_96286; Strand=-; Position=270-464
PIPSFMRHQLHSFLVLPNCLKCIPKNALKMIKPVFSRIFCQYFPIRNDTVNSFASLIHSCFASD

SEQ ID NO: 169864 - protein, 126 aa, Heterodera glycines
  Homolog annotation: Hit_ID=NP_492207.1; Match level="QueryCoverage =61%, HitCoverage=31%, E-value=6e-16, Identity=51%"; Hit description =cytochrome c1 (31.0 kD) (1I600) [Caenorhabditis elegans] emb|CAA99820.1| Hypothetical protein C54G4.8 [Ca
  Gene Ontology: Mol. function=cytochrome c; Cellular component =mitochondrion; Biological process=positive regulation of embryonic development
  Coding regions on vcDNA: vcDNA=SeqID_96287; Strand=+; Position=91-471
MLIMSFRSAAALGLNLRKASKFVLFGALATGGSVLLYSLENSGARAYDFVVHPSHFFWVRRGYQVYKQVCAACHSLKFIRYNHFVDNFMTRDEAKTEAAEKNAFTRRNFSKYTNCCPRIGCIEGRK

SEQ ID NO: 169865 - protein, 109 aa, Heterodera glycines
  Homolog annotation: Hit_ID=AAR03852.1; Match level="QueryCoverage =76%, HitCoverage=29%, E-value=5e-22, Identity=61%"; Hit description =cytochrome c1 [Tigriopus californicus]
  Gene Ontology: Mol. function=cytochrome c; Cellular component =mitochondrion; Biological process=positive regulation of embryonic development
  Coding regions on vcDNA: vcDNA=SeqID_96288; Strand=+; Position=3-332
GGSVLLYSLENSGARAYDFVVHPSHLPWSHGGLMDAIDMRSVRRGYQVYKQVCAACHSLKFIRYNHFVDNFMTRDEAKTEAVEKNAFTRRNFSKYTNCCPRIGCIEGRK

SEQ ID NO: 169866 - protein, 50 aa, Heterodera glycines
  Coding regions on vcDNA: vcDNA=SeqID_96289; Strand=-; Position=1-150
FDISPSANRSECQQKRMSKINNSQSGNKALAATRPTFGTAKFNLAVPLPF

SEQ ID NO: 169867 - protein, 428 aa, Heterodera glycines
  Homolog annotation: Hit_ID=AAH46263.1; Match level="QueryCoverage =86%, HitCoverage=54%, E-value=4e-24, Identity=26%"; Hit description =LOC398566 protein [Xenopus laevis]
  Gene Ontology: Mol. function=general transcriptional repressor activity; Cellular component=nucleus; Biological process=negative regulation of transcription
  Coding regions on vcDNA: vcDNA=SeqID_96290; Strand=+; Position=6-1289
MAIEAEEFGEQHETDEVEQQENGSGNSEEEEEEEEAPQIRRQQGQIRMMTSSGEETVQATEAAVPPPAAQQAPPQSPAATAAAPQSPAPTQTAAPASPGSAAAIPQSPAAAGAAAAAQQAALEEAKRRQQEAMEKARAEALRLQEEARARAEAARQQHQQAAEQARLQAEQQLKAQQEAAKRQAEERAQQLKAQQQQQQQQSVQVQQQKQQQPPISPSATAQQQKAAPAPAAQPPAKAPQQPQAPKAAVAPAQQQQQPKAAAPPPPKAAAAPQQPKATAVAAPPKPTAPPAVAPQKRAPSPVVREVQLPEAPTQPILRHAEYTPKLVDASVNKLPPGQEPDEEQLEASAVPRNPIIEDNAWQVQRRVQPEYQPVQPAKLNATGDFLVESEAKKSIVPEAVGYSKTKWNEFPEEEEKERQSVPKVKRRN

SEQ ID NO: 169868 - protein, 136 aa, Heterodera glycines
  Coding regions on vcDNA: vcDNA=SeqID_96291; Strand=-; Position=26-593
MNKSLAAPVKNTAGGKVEGAVAAPNGQHSGRQRHGGGEDGSGRRNVTRWGTAGSGGGGGGRRTRGRMARDDRFQFASVAVPIPRGCPLVGTSVCCCCRCACCCCSSLLSQSTVVPPCCPITTTTVLSFPSSMVLPC

SEQ ID NO: 169869 - protein, 140 aa, Heterodera glycines
  Coding regions on vcDNA: vcDNA=SeqID_96292; Strand=+; Position=25-447
NKVFPLSKNILSNFLSYFLQIVDRVRVHRHSLCAGGAAGPSSFCCPSSFSSLSISTPPLAPNHHHQQPKQHFHQQQQQQLSFISAPCALHSSHGPSTTTANAIPAQLFMLSKNGRECSKLREMVSSLGEQLNVPSTTKIS

SEQ ID NO: 169870 - protein, 208 aa, Heterodera glycines
  misc_feature (123)..(123): Xaa can be any naturally occurring amino acid
  Homolog annotation: Hit_ID=CAI02740.1; Match level="QueryCoverage =87%, HitCoverage=87%, E-value=1e-28, Identity=33%"; Hit description =hypothetical protein PB300893.00.0 [Plasmodium berghei]
  Gene Ontology: Mol. function=cell adhesion receptor activity; Cellular component=cell wall (sensu Fungi); Biological process =agglutination during conjugation with cellular fusion
  Coding regions on vcDNA: vcDNA=SeqID_96293; Strand=+; Position=3-628
QLYLFNHSCTSFNHSCTFSDHCCTSSNHFCTSSSNLYLFNLCCTSSNHFCTSSSNLYLFNLCCTSSNHFCTSSDHCCTSSNHCCTSSDHFCTSSNHFCTSSNHFCTSSNHFCTSSNHCFTFLXSSCTSSNHSCTSSDHCCTSSDHCCTSSNHFCTSSNHFCTSSNHFCTSSNHSCTSSNHSCTSSSKLQNFWKNSNFQKKIHNSVLKR

SEQ ID NO: 169871 - protein, 115 aa, Heterodera glycines; identical to SEQ ID NO: 162762
  Coding regions on vcDNA: vcDNA=SeqID_96294; Strand=+; Position=46-393

SEQ ID NO: 169872 - protein, 238 aa, Heterodera glycines
  Homolog annotation: Hit_ID=CAE75423.1; Match level="QueryCoverage =89%, HitCoverage=44%, E-value=1e-88, Identity=42%"; Hit description =Hypothetical protein CBG23416 [Caenorhabditis briggsae]
  Gene Ontology: Mol. function=structural constituent of muscle; Cellular component=striated muscle thick filament; Biological process=striated muscle contraction
  Coding regions on vcDNA: vcDNA=SeqID_96295; Strand=+; Position=3-716
SWSSPRWRPLINSGSPGLQSLGTREQRQRDELREQFLNSEKRNQILQSEKEELMHQAEQAERARRAAEADLIELREAVNDLSNQVNSLNGYKRKLEGELQALHAELDETLTELKNADELSKKASADAARLAEELRQEQEHSQHVDRLRKGLELQIKEMQVRLDEAEAAALKGGKKIIAKLEERIRALEQELDGEQRRHQETDKNYRKAERRVKELDFQVEEDKKNTERLTDLIDKLQG

SEQ ID NO: 169873 - protein, 193 aa, Heterodera glycines
  Coding regions on vcDNA: vcDNA=SeqID_96296; Strand=+; Position=3-581
LVMYIRELESPDEHSLVLFNPLRSCFRPTRDELFSAIACQRRSIVRLNTERARFVRQNGALLRMIVRLTGGIPPNFNHAHFAAAAQPVVNVTAVIANANPNGQNYNRLQRLHAELSETIDRFTEENSLLGYMNDQLTEQLEPLTEVPPNANFNLDDVVFHPPLDQQHEVPPNPNFNPALLEFDDVGLQPALDQ

SEQ ID NO: 169874 - protein, 156 aa, Heterodera glycines
  Homolog annotation: Hit_ID=CAE57522.1; Match level="QueryCoverage =100%, HitCoverage=8%, E-value=8e-70, Identity=78%"; Hit description =Hypothetical protein CBG00497 [Caenorhabditis briggsae]
  Gene Ontology: Mol. function=helicase activity; Cellular component =nucleus; Biological process=establishment and/or maintenance of chromatin architecture
  Coding regions on vcDNA: vcDNA=SeqID_96297; Strand=+; Position=3-470
LNNVDYAGLRSDNSEVRRKQLDNIAVAALEFQPKGNTLETTEVKTEVPFLIRGDLREYQLVGLDWLVTLYEKNLNGILADEMGLGKTIQTIALLAHLACDRAVWGPHLIIVPTSVILNWEMELKKWCPALKVLTYFGTAKERAEKRKGWSKSNAFH

SEQ ID NO: 169875 - protein, 163 aa, Heterodera glycines; identical to SEQ ID NO: 162817
  Coding regions on vcDNA: vcDNA=SeqID_96298; Strand=+; Position=58-549

SEQ ID NO: 169876 - protein, 266 aa, Heterodera glycines
  misc_feature (166)..(166): Xaa can be any naturally occurring amino acid
  Homolog annotation: Hit_ID=NP_499013.1; Match level="QueryCoverage =77%, HitCoverage=33%, E-value=5e-62, Identity=56%"; Hit description =acyl-CoA carboxyltransferase (66.5 kD) (3K174) [Caenorhabditis elegans] emb|CAA79618.1| Hypothetical prot
  Gene Ontology: Mol. function=methylcrotonyl-CoA carboxylase activity; Cellular component=mitochondrion; Biological process=isoleucine catabolism
  Coding regions on vcDNA: vcDNA=SeqID_96299; Strand=+; Position=3-801
PRELIGSLINNKNRLIWQFSSFSSILFNKSRKKQLNFLHLNFLRSTSASSSCVESFPEWRHQNMSNEFSPSNWPILPTTVQPDSEQFKQNEAEMAESISEFKNVVDAVIDGQMVEKTVIERHKNKGKLLAIERIEQLIDQGGSFLELSQLTAYKVYGQEKVPAGGXVAGIGPICGRLCVIVANDATVKGGTYYPITVKKHLRAQEIALENCLPCVYLVDSGGANLSRQAEIFADKDNFGRIFFNQAQMSAKGIPQIAVVMGSCTAG

SEQ ID NO: 169877 - protein, 139 aa, Heterodera glycines
  Homolog annotation: Hit_ID=CAE58368.1; Match level="QueryCoverage =99%, HitCoverage=24%, E-value=9e-39, Identity=59%"; Hit description =Hypothetical protein CBG01494 [Caenorhabditis briggsae]
  Gene Ontology: Mol. function=asparagine synthase (glutamine -hydrolyzing) activity; Cellular component=soluble fraction; Biological process=asparagine biosynthesis
  Coding regions on vcDNA: vcDNA=SeqID_96300; Strand=+; Position=3-419
CCASLDGVFAFAMADKKFLYLGRDPIGVRPLFYGFAGQALLIGSEVKSIEKLCRRVNFFPPGFCAQIPLGSTFSTDNQQIAFQQFFQIPSIVNYSISAFDAKAIIRKLLVEAVEKRLMDNRQFGFMLSGGLDSSLIAAL

SEQ ID NO: 169878 - protein, 166 aa, Heterodera glycines
  Coding regions on vcDNA: vcDNA=SeqID_96301; Strand=+; Position=1-498
ERLFLKMGRRRKTAPALLRNKRTRIDEDEMDEEEEGAWNGHGHQNMGLRPRKQIQRTISAQWAPRLRERHQNGQNTTEDQLADMELEDVDMDEDEIVKTLNMVFTNLDLSQLPALSPGAGLYAMANYAIEEKSIPKRKAAEKKVPEDVLEPTFLSLEQAMQRDQNF

SEQ ID NO: 169879 - protein, 84 aa, Heterodera glycines; identical to SEQ ID NO: 162814
  Coding regions on vcDNA: vcDNA=SeqID_96302; Strand=+; Position=86-340

SEQ ID NO: 169880 - protein, 215 aa, Heterodera glycines; identical to SEQ ID NO: 162658
  misc_feature (64)..(64): Xaa can be any naturally occurring amino acid
  Homolog annotation: Hit_ID=NP_490730.2; Match level="QueryCoverage =42%, HitCoverage=18%, E-value=9e-23, Identity=49%"; Hit description =zinc finger Cezanne (72.7 kD) (1A885) [Caenorhabditis elegans] gb|AAF60741.2| Hypothetical protein Y50C1A
  Gene Ontology: Mol. function=ubiquitin C-terminal hydrolase activity; Cellular component=cytoplasm; Biological process=protein deubiquitination
  Coding regions on vcDNA: vcDNA=SeqID_96303; Strand=+; Position=27-675

SEQ ID NO: 169881 - protein, 158 aa, Heterodera glycines
  Homolog annotation: Hit_ID=XP_421149.1; Match level="QueryCoverage =94%, HitCoverage=3%, E-value=4e-11, Identity=26%"; Hit description =PREDICTED: similar to Spectrin beta chain, brain 4 (Spectrin, non -erythroid beta chain 4) (Beta-V spectrin
  Coding regions on vcDNA: vcDNA=SeqID_96304; Strand=-; Position=3-476
CRESLGTSEGAKKMLACANTLQNEIVPWRKAFGELRQRGEQLAKRGHESVAERMERVENQAKALEGMAKEAARGAGSVLAVRSFLADGAELEEWMEQQKQTTNIEECGNDLEQCEQLRTKFEEFRQSLRMGDERMAKVEEAEGELISHVDDEKLAQKV

SEQ ID NO: 169882 - protein, 62 aa, Heterodera glycines
  Coding regions on vcDNA: vcDNA=SeqID_96305; Strand=-; Position=127-315
NLAKERSDVCCLFNEHEYRRVLFDEYSPKQIQNPGNANSTADCCESKLLPTFKGKGRKLTMW

SEQ ID NO: 169883 - protein, 243 aa, Heterodera glycines
  Homolog annotation: Hit_ID=CAD58848.2; Match level="QueryCoverage =93%, HitCoverage=19%, E-value=5e-37, Identity=38%"; Hit description =SMC2 protein [Takifugu rubripes]
  Gene Ontology: Mol. function=ATP-binding cassette (ABC) transporter activity; Cellular component=nucleus; Biological process=chromosome organization and biogenesis (sensu Eukarya)
  Coding regions on vcDNA: vcDNA=SeqID_96306; Strand=+; Position=2-730
EIVIGDPPGCFTQNEVTTDEEGREVTLEVQPTATRTQLSEHQTNVKKAEMRLGQLNKTLSKKRSELQQTSRHSLSQNDTKRELEVGIEQLEQKLRALYFDPQLDHQLEQERVQLARERGQCAQELDRFEARNFKLRFDYTMPYNGFDRNKVKGVVAKLFKMNEQRYATALEVVAGGRLFHVVIDKVKTGEDLLKAGLPRRVTMLPLDKISANVLDQRLIGQAKRMVGEENVFFPGELIEYERE

SEQ ID NO: 169884 - protein, 197 aa, Heterodera glycines
  misc_feature (68)..(68): Xaa can be any naturally occurring amino acid
  misc_feature (172)..(172): Xaa can be any naturally occurring amino acid
  Homolog annotation: Hit_ID=CAE71361.1; Match level="QueryCoverage =79%, HitCoverage=30%, E-value=5e-48, Identity=63%"; Hit description =Hypothetical protein CBG18265 [Caenorhabditis briggsae]
  Gene Ontology: Mol. function=UTP-glucose-1-phosphate uridylyltransferase activity; Biological process=embryogenesis and morphogenesis
  Coding regions on vcDNA: vcDNA=SeqID_96307; Strand=+; Position=43-635
MAMLNASFDKFNISNSDKIRTQRLISMSESCEEWKTCTKRETYALLDQELNKLLTTSPPEKMEYWKYXLDGFMDLFARFLRAKTTVEWSKIEPLPEGAITPYSKLEQTPRDRVRELLNGLVVVKLNGGLGTSMGCKGPKSIISVRNELTFLDLTLQQIQSLNREFEVNVPLXVLMNSFQHRPTTLRSCLKTDPTCLR

SEQ ID NO: 169885 - protein, 378 aa, Heterodera glycines
  Homolog annotation: Hit_ID=CAE65931.1; Match level="QueryCoverage =94%, HitCoverage=23%, E-value=1e-104, Identity=53%"; Hit description= Hypothetical protein CBG11104 [Caenorhabditis briggsae]
  Gene Ontology: Mol. function=amylo-16-glucosidase activity; Biological process=glycogen catabolism
  Coding regions on vcDNA: vcDNA=SeqID_96308; Strand=+; Position=2-1138
SVLRLYPTDEVEYGEQTKTEPLSATMFEALSRHFLGIDFRERNAGHRIDEHMRDEGFNVKAYIDGHSGLIFGGNRWNCGTWMDKMGSSERAGNRGEPATPRDGAAVELQGLALCVARGLDRLCRDGAFPYNGMKGESSSFLSWSDWAAKIQHSFEQHFFVDHNCQSEFVHRRPIVKDSFGASLAFADFQLRPNFCIALNASPDILPPEKAWAALEIAGEVLAKNAPYGICTLDPKDWAYNGNYDNDDDGTNRISAKGWNYHQGPEWLWVAACYMSAKLKVASLLLHKSGDSSAWLSAVGEIRQRLFALEQCLNRSDWASLPELTIRAGAFCAHSCPAQAWSVGCVMETLDTLEAMEKEGMNLEGRKSDRRANDKQKKH

SEQ ID NO: 169886 - protein, 58 aa, Heterodera glycines; identical to SEQ ID NO: 165401
  Coding regions on vcDNA: vcDNA=SeqID_96309; Strand=+; Position=81-257

SEQ ID NO: 169887 - protein, 164 aa, Heterodera glycines
  Homolog annotation: Hit_ID=NP_501391.1; Match level="QueryCoverage =68%, HitCoverage=14%, E-value=1e-09, Identity=36%"; Hit description =squamous cell carcinoma antigen recognized by T-cells 3 like (86.8 kD) (4J52) [Caenorhabditis elegans] gb
  Coding regions on vcDNA: vcDNA=SeqID_96310; Strand=-; Position=2-493
MKIRQMSSSSDDENELQLSDTDCEAGPSSRKKSKAPKSQTHHRKWGPKASSLEEEDDEDEETLVEREVERTETGRPLRKAAVNMRKKLKEELQYEEEEDEGEETEQRDEEEEGTAAGAQIGRLADRAVSALARPQRTVGNRSEEGDADEFKPDEEDEAEADEEE

SEQ ID NO: 169888 - protein, 47 aa, Heterodera glycines
  Coding regions on vcDNA: vcDNA=SeqID_96311; Strand=-; Position=87-230
RTSVSRAKCCAKMPTFCLTTSNPVPAKWRAHAVSAQECKLFNFSVVR

SEQ ID NO: 169889 - protein, 161 aa, Heterodera glycines; identical to SEQ ID NO: 165384
  misc_feature (53)..(53): Xaa can be any naturally occurring amino acid
  misc_feature (85)..(85): Xaa can be any naturally occurring amino acid
  Homolog annotation: Hit_ID=CAE71050.1; Match level="QueryCoverage =99%, HitCoverage=36%, E-value=1e-37, Identity=43%"; Hit description =Hypothetical protein CBG17892 [Caenorhabditis briggsae]
  Gene Ontology: Mol. function=formaldehyde dehydrogenase (glutathione) activity; Cellular component=cytoplasm; Biological process=alcohol metabolism
  Coding regions on vcDNA: vcDNA=SeqID_96312; Strand=+; Position=55-536

SEQ ID NO: 169890 - protein, 163 aa, Heterodera glycines
  Coding regions on vcDNA: vcDNA=SeqID_96313; Strand=+; Position=3-491
SEFGKYRPLPSDRKCSRKGCASDPPPATHCQPGHSSENGTVQPTKTSSLISSKNGCAEAEEEQCLFVEHFGPIPQYSETDEKENLRLRKLHEVALEIYQKQRAYVMKLQLIGLNYPRHLNDCEKRMNKKLLHSKHVIRRIADHFQTILNVHLTFLHNFYDKIL

SEQ ID NO: 169891 - protein, 64 aa, Heterodera glycines
  Coding regions on vcDNA: vcDNA=SeqID_96314; Strand=+; Position=201-392
VKHLKQLSNRRHQQSNSGEKSRFLNNIWVNCKHFRHLDQPREIGLQSCARLTRHPQKANTHFKG

SEQ ID NO: 169892 - protein, 117 aa, Heterodera glycines
  Coding regions on vcDNA: vcDNA=SeqID_96315; Strand=+; Position=154-507
EKNGVSKNRNYAQKASQPILAHPIPSTIAFIHPIMNAKIIRVPKIACDLSLEKNGVSKNRNFAQKASQTILAHPIPSTIAFMHPIMNAKIIRVPKIACDLRLRKKKLEGGPGTQFAL

SEQ ID NO: 169893 - protein, 181 aa, Heterodera glycines
  Coding regions on vcDNA: vcDNA=SeqID_96316; Strand=+; Position=108-650
FSVICRTMCQKFVAMPSFVHHHLTLLCLFLGALCAFGAVPSLCQLLGAPGGCSPIAVLSAAQQPNGGGAAAQFQQPFGPAFGCPLNPLGAFGRPFPPPPPPPPPGIGGQFPSMQGQTVNLSPNFMGGGQQQQQNGGNAFGTMGGGGNCNCGTCCQQQQETNGNSNNNNFIGMPTANEFTGF

SEQ ID NO: 169894 - protein, 62 aa, Heterodera glycines
  Coding regions on vcDNA: vcDNA=SeqID_96317; Strand=-; Position=3-188
LFFFLIQISWKFPIPDKRNVGRGFRISCLFFQQINFVSVSILVSDGQSMQKWVRDHPGMCCQ

SEQ ID NO: 169895 - protein, 159 aa, Heterodera glycines
  Homolog annotation: Hit_ID=NP_492140.1; Match level="QueryCoverage =80%, HitCoverage=25%, E-value=4e-25, Identity=44%"; Hit description =RalA binding protein 1 like (1I269) [Caenorhabditis elegans] emb|CAB03414.2| Hypothetical protein T23G11.
  Gene Ontology: Mol. function=GTPase activator activity; Biological process=signal transduction
  Coding regions on vcDNA: vcDNA=SeqID_96318; Strand=+; Position=149-625
MNFFGRKGKKGPVVGKEGKEKGERPSHRRLRVLGVPLAQALRNDPSHDGVPVPAVVRECLDFISLYGLQVEGVFRVSSPKSRLDELERMANEGRTDEIVFQDAHEAAGLLKRFLRQLPENVLTTQLKGRFENEANVCRCVALCRCSAVIKLRELLLQLP

SEQ ID NO: 169896 - protein, 96 aa, Heterodera glycines; identical to SEQ ID NO: 162799
  Coding regions on vcDNA: vcDNA=SeqID_96319; Strand=+; Position=38-328

SEQ ID NO: 169897 - protein, 144 aa, Heterodera glycines; identical to SEQ ID NO: 162798
  Homolog annotation: Hit_ID=CAE58316.1; Match level="QueryCoverage =74%, HitCoverage=77%, E-value=5e-21, Identity=48%"; Hit description =Hypothetical protein CBG01427 [Caenorhabditis briggsae]
  Coding regions on vcDNA: vcDNA=SeqID_96320; Strand=+; Position=16-450

SEQ ID NO: 169898 - protein, 160 aa, Heterodera glycines
  Coding regions on vcDNA: vcDNA=SeqID_96321; Strand=-; Position=2-481
VKLKRLDGEWESIELSEVPTICTPIRTEFVIPGGTPGQHCSATDTVQPQLLIGIRRFWDFVQGFRKTAEGTYLIDTVFGTVICGEQFQTTTGVTPDSSVFAIPPCGEDERDQMPSVKAIEQFWSVEAIGIRDDPTQDADTEAIIQFERSVRQHDDGRYSI

SEQ ID NO: 169899 - protein, 70 aa, Heterodera glycines
  Coding regions on vcDNA: vcDNA=SeqID_96322; Strand=-; Position=2-211
FFQFLKKFRRQQWYCSPTFFLNFPSHRRHFFEEYPPPSPTFSQIDRVGEEPLGLNMTKFIKHKGNNWKKC

SEQ ID NO: 169900 - protein, 72 aa, Heterodera glycines
  Coding regions on vcDNA: vcDNA=SeqID_96323; Strand=+; Position=1-219
MEGKSRSGRRRDCEGLWEKQSLLDPPPPFVLYINCPSLPTSICCANNKMLTPPFPRRICPFDSIDKILRNSN

SEQ ID NO: 169901 - protein, 111 aa, Heterodera glycines
  Coding regions on vcDNA: vcDNA=SeqID_96324; Strand=-; Position=53-388
LIVCLFVISRQPSVAFNALSQFSRDFPSPDFSFVEIVFLPITAQINENHLPIVLSFFLFSHNPISDSAPSSGFIECACLSHFLLSVPPPQKGASAVVVLPKPSAGQSICDH

SEQ ID NO: 169902 - protein, 55 aa, Heterodera glycines
  Coding regions on vcDNA: vcDNA=SeqID_96325; Strand=-; Position=1-165
FTFSSIIRCATSVAFWRAVCLTNGSTCIVRGKSSGQFDGTTIGSRPFRKRFKFYL

SEQ ID NO: 169903 - protein, 155 aa, Heterodera glycines
  Coding regions on vcDNA: vcDNA=SeqID_96326; Strand=-; Position=1-465
LVPIAISDVTHFADFVDVRATRFDNSGLNSSFASHRFECHCVFVHFLLKVVEHHTHFGIRCENNCISIGVSIKKLATEVGLNGANFSLKCAVSPLGALKTSPVSVEEPFDRNRHVLFGALFSGGGVLRQFDVIVLVVSHQQGKVGVWFGIYFVLN

SEQ ID NO: 169904 - protein, 74 aa, Heterodera glycines; identical to SEQ ID NO: 162794
  Homolog annotation: Hit_ID=AAH63374.1; Match level="QueryCoverage =85%, HitCoverage=10%, E-value=3e-11, Identity=50%"; Hit description =Hypothetical protein MGC76021 [Xenopus tropicalis] ref|NP_989196.1| hypothetical protein MGC76021 [Xenopus
  Coding regions on vcDNA: vcDNA=SeqID_96327; Strand=+; Position=77-301

SEQ ID NO: 169905 - protein, 59 aa, Heterodera glycines
  Coding regions on vcDNA: vcDNA=SeqID_96328; Strand=-; Position=0-176
INENFQTNFLHLFQRINHFGLNDRILFEFRFTFHITFLRRVYSKKLLGKKGVRRCREAP

SEQ ID NO: 169906 - protein, 126 aa, Heterodera glycines
  Coding regions on vcDNA: vcDNA=SeqID_96329; Strand=-; Position=195-575
EGLKNKAQGGFILGNTVFYFFSQVLNEMLLRMDAEVFGALAPAEFSAGVGTAPSSFVSTPHARHRHSYADGPTVPSRSHIPPWAWSRNLEFNLAIHYGRNSGASRIKARFLSSERCDWPKPRKFEN

SEQ ID NO: 169907 - protein, 323 aa, Heterodera glycines
  Homolog annotation: Hit_ID=CAE56992.1; Match level="QueryCoverage =85%, HitCoverage=71%, E-value=2e-98, Identity=62%"; Hit description =Hypothetical protein CBG24859 [Caenorhabditis briggsae]
  Gene Ontology: Mol. function=transcriptional activator activity; Cellular component=cytoplasm; Biological process=regulation of cholesterol biosynthesis
  Coding regions on vcDNA: vcDNA=SeqID_96330; Strand=+; Position=4-972
MPKSKIQSASILAEQQKSVFSCQPTIPAADESDDLSNSSHLNCCQPISEIEQHQINDLRQILETQLLKQEVDEAYLLRWLRSKEGKFDEAADGIRKDLVFRKAWGLDKIVNWEAPEILEKYCGYGFLSDHDGNPILMSLLGNTDVEGMLRSVQSKDYIKFSLAAIEKGITLCRERALQTGRPFEQMMLVFDLDHISSAHYSSKQFASSFTTLVLLFQEHFPLVLRKILVIRAPEMGRIAFNSMTPFLSNAIKSMIEMPSEEGWQSALSKYVNLDAWPVHWGGRMMDPNGDPKCPSKIRYGLGPVPDSFFVDPSQAMPDYDPLT

SEQ ID NO: 169908 - protein, 189 aa, Heterodera glycines; identical to SEQ ID NO: 163903
  Coding regions on vcDNA: vcDNA=SeqID_96331; Strand=+; Position=74-640

SEQ ID NO: 169909 - protein, 161 aa, Heterodera glycines
  Coding regions on vcDNA: vcDNA=SeqID_96332; Strand=-; Position=1-483
KVKAALIIAGRDSLLRGETVEMMMEQYEMIANLCRRFAHVKFFWTCPPYVHDKHDEYEELVARLGPMMSLNPFIPVWVTKKGRSIHELFRFGNSFDNMRVTSDGLMKDAGVRALKAWLFTQSDFSGDQKLKIRTIRSAVHVAASVGLGDHRQPSTSSSGSI

SEQ ID NO: 169910 - protein, 96 aa, Heterodera glycines
  Coding regions on vcDNA: vcDNA=SeqID_96333; Strand=-; Position=18-308
LNVCLFLLLPNVLTLPIANSFLSSLFLLLLQNNAFLSLSSVKFPFYHFPYFFIFYHFPFITNCSFSVCCPSAVCLFLLPYVFFYSTEKGQCNCEFY

SEQ ID NO: 169911 - protein, 41 aa, Heterodera glycines
  Coding regions on vcDNA: vcDNA=SeqID_96334; Strand=-; Position=173-298
KGAGGKFYGIKSYLNSFYHTPTVVEEIESGKAQEGTTTWSV

SEQ ID NO: 169912 - protein, 146 aa, Heterodera glycines
  Homolog annotation: Hit_ID=EAA01159.2; Match level="QueryCoverage =92%, HitCoverage=27%, E-value=8e-37, Identity=54%"; Hit description =ENSANGP00000018451 [Anopheles gambiae str. PEST]
  Gene Ontology: Mol. function=ubiquitin conjugating enzyme activity; Cellular component=endoplasmic reticulum; Biological process=signal transduction
  Coding regions on vcDNA: vcDNA=SeqID_96335; Strand=+; Position=114-551
MHFADLSLSEREKALSVRYLQERDAMFERFSEWTEQDQTDFCKHLLQRMCHHQHGQIDQFLGPMLQRDFIALLPTGLAENVLHLLDAKSLCASEFVSRRWSRVIVNGLLWRKHIERQVRNDALWAGLAIRRGWKKYFFCSKDQATR

SEQ ID NO: 169913 - protein, 34 aa, Heterodera glycines
  Coding regions on vcDNA: vcDNA=SeqID_96336; Strand=+; Position=25-129
LIKHFYNNLTNKYYLIITLVPFSFKIKNWENSVN

SEQ ID NO: 169914 - protein, 212 aa, Heterodera glycines
  Homolog annotation: Hit_ID=NP_505876.1; Match level="QueryCoverage =98%, HitCoverage=26%, E-value=5e-47, Identity=40%"; Hit description =zn-finger, RING and Zn-finger, B-box (5L798) [Caenorhabditis elegans] emb|CAA98481.1| Hypothetical protei
  Coding regions on vcDNA: vcDNA=SeqID_96337; Strand=+; Position=1-636
CTDTVQQNPLHCLRCFSPIKCPVRLPCQHYFCRLCIADEKCCVICGHPIGCSELVEDKVLNYVLESSSEVTETCANFYQISQPMFFCDTCHQPLCSGCRETTHKAKIFSTHHIFELEERGRLRSRPICPQHNEPFILFCLDSKSLMCIECFNSSSLERRGHFVNIELAHKICCDKLEKNALNLRIFQEELREQIELRKRLTDELSKNSENLR

SEQ ID NO: 169915 - protein, 161 aa, Heterodera glycines
  Coding regions on vcDNA: vcDNA=SeqID_96338; Strand=+; Position=392-874
LINNKELQMALFANVFTTKYLPKEVTLLVFRRSNSEFFCVRRSPTIFEQTRQQHSNSSRRNDQIQQILDQFDKMQLPSQNEPLATSQQQIVQLSERLIQLALTATNLVCNLLQKNGAAATDQFKGQTKMPTVATIEPKNTKRDGRAAENEKGWTWICEKCR

SEQ ID NO: 169916 - protein, 189 aa, Heterodera glycines
  Coding regions on vcDNA: vcDNA=SeqID_96339; Strand=+; Position=3-572
AKSTSLYTKFGCKNSCSKKKCIKGDGFLHFSPVPASLQLNATSTPVRAKLVYTFRRDNSSLHHERHERLHGIRPRRACTVVRRRGSLFIVRSRERLHGIRPRRACTVVRRRGSLSIVRSRERLHGSLARVRAASGWFKGDTGANASLIFCFCSRRSPRIRAPTCEKMQQRPADGWTKPEERATCQKMQR

SEQ ID NO: 169917 - protein, 208 aa, Heterodera glycines
  Coding regions on vcDNA: vcDNA=SeqID_96340; Strand=+; Position=2-625
EDKKAANNTCSSNNNNSLSDVKQNDDVSSLDSLGVFLNRFRQMDTKKLQQLASNPTVVAQSNGPNEGTAKDTNNDNTSITSTREKMLEVVYGNKLMGKEKQPKFMCFVVDAQERKIRIMSREEQKKQESSAIILEDLTDDQFSRFGKSVKDKEADNSDAFVHCEKCSLFYEFCCLDHPLYQCKDRVPSSSPTEIEDRAAATLPAFLFI

SEQ ID NO: 169918 - protein, 130 aa, Heterodera glycines
  Coding regions on vcDNA: vcDNA=SeqID_96341; Strand=-; Position=29-421
DRLNHPDEIQKVEKYVKGKTLQTTYKNQLDEYKDFEYGGITRESARKQMAYNGFKNVTVDQHFYVRHRICLRYSSNPCVIEKHKNGNERFYPLELVKVKDNDIIYLGQNFPKPLIRDDNMFIDDQQYLNW

SEQ ID NO: 169919 - protein, 95 aa, Heterodera glycines; identical to SEQ ID NO: 138780
  Coding regions on vcDNA: vcDNA=SeqID_96342; Strand=-; Position=789 -1076

SEQ ID NO: 169920 - protein, 92 aa, Heterodera glycines
  Coding regions on vcDNA: vcDNA=SeqID_96343; Strand=-; Position=68-346
CSSFISFSISILIFLILIYYLLFYILIFIFIFIVVPIGPNLCNCRFDLITPFHFLIYLFSPRLSASYRMPAYKISFLLQFTIHGPSKIYIIK

SEQ ID NO: 169921 - protein, 30 aa, Heterodera glycines
  Coding regions on vcDNA: vcDNA=SeqID_96344; Strand=-; Position=1-90
TINFLTYLLVKAHILLSNDILKLHFLGQWC

SEQ ID NO: 169922 - protein, 187 aa, Heterodera glycines
  Homolog annotation: Hit_ID=XP_309989.1; Match level="QueryCoverage =63%, HitCoverage=42%, E-value=2e-11, Identity=29%"; Hit description =ENSANGP00000015194 [Anopheles gambiae] ref|XP_319667.1| ENSANGP00000022407 [Anopheles gambiae]
  Coding regions on vcDNA: vcDNA=SeqID_96345; Strand=-; Position=2-562
RSTANIRDTISPTQPDQVNWNDITSQLKQLFAETRSLFVRRFECFKIRQQQGQDISSLIAQINASCENADLSLTKEQLKCIILVIALNDEHHDLRQKALKMLDDSQKNGTDISLKKIEEELRAIQLVKESALSLVNPPIATNAIRTRCKFKRKANAWSTDASMRIMWQIRPLALRLHIQGRHLPQVQ

SEQ ID NO: 169923 - protein, 121 aa, Heterodera glycines
  Coding regions on vcDNA: vcDNA=SeqID_96346; Strand=+; Position=47-409
MILASSSKRLACQFLIRKVPHFAVTSSRKESNWSEVLDEAVPARKSYRDFQTLNGNQRDALAASLDDSKSMVTVLGSPGTGKTLLVTELVHSMCTKKQRVLVICGSRELLYSTVCRYFRRA

SEQ ID NO: 169924 - protein, 209 aa, Heterodera glycines
  Coding regions on vcDNA: vcDNA=SeqID_96347; Strand=+; Position=49-675
MLFPSFGMLSSAIHQNQHRRSVHSVRYHSPLLSWPKLFLISIATIPLLLLSCIDFVSAVSDDGAPFLSDQQKRGGARAFNLFASAAFPPPNEKRSGGRAFGGGIQTINDDFDANLAGELKRAGARLFRMSDLSSDGDSFVPEGTKRGGARPFYGGGYIDGAWKRAGGRYFLRQFDDVPFGGGWMAKRGGGRSFFEGTKGPFNSANYWAP

SEQ ID NO: 169925 - protein, 158 aa, Heterodera glycines
  Homolog annotation: Hit_ID=NP_501035.1; Match level="QueryCoverage =66%, HitCoverage=11%, E-value=4e-16, Identity=43%"; Hit description =ubiquitin specific protease 15 (102.6 kD) (4H525) [Caenorhabditis elegans] gb|AAC68977.1| Hypothetical pr
  Gene Ontology: Mol. function=ubiquitin-specific protease activity
  Coding regions on vcDNA: vcDNA=SeqID_96348; Strand=+; Position=3-476
SIIVDLLHGQHKSTLTCNVCSKISIKFEPFCFLSVPVPTKEHKAQSTIVFMRAEKWAKFHVTHTSKTTAGQLKQMLREELQLPSNTQMIIYSTYSNRILKDDSTLSSTYMYNYSMKLYAYAVEPGPVILVENLFMATSPPLFFPRPTKLTRRALLAEL

SEQ ID NO: 169926 - protein, 114 aa, Heterodera glycines; identical to SEQ ID NO: 163708
  Coding regions on vcDNA: vcDNA=SeqID_96349; Strand=-; Position=81-425

SEQ ID NO: 169927 - protein, 246 aa, Heterodera glycines
  Homolog annotation: Hit_ID=CAE67540.1; Match level="QueryCoverage =100%, HitCoverage=24%, E-value=1e-61, Identity=47%"; Hit description= Hypothetical protein CBG13065 [Caenorhabditis briggsae]
  Coding regions on vcDNA: vcDNA=SeqID_96350; Strand=+; Position=2-799
ELQLESEDRYNRFPFSQKEFIEDCPAERLYVRILPEMTEYVIALLKVILASLPSSKAKIDAVTILSDVLTPETDTNEVLSNSISLDLASFSHTNVLEETVRVAIDINRHKELIIKSASSLLILLLKHLRLNHTLQFENLARYLVLANCLPLVLKFLDQNICRYFQAKHELAPFNYPQCALFFVRNGYVCPPLTAENVDGCGGSSDSPSYFLWRNGFSSINLLRVINKLTKGKQSRTQMLVVYKWAP

SEQ ID NO: 169928 - protein, 68 aa, Heterodera glycines
  Coding regions on vcDNA: vcDNA=SeqID_96351; Strand=-; Position=60-266
PLLIDCCAHSNSKLSQMSKSSTSNTSYSSSSSSSGFLEAISGEENEQKLKKGEEETLATAAKPIDKAI

SEQ ID NO: 169929 - protein, 126 aa, Heterodera glycines
  Homolog annotation: Hit_ID=CAE61387.1; Match level="QueryCoverage =100%, HitCoverage=27%, E-value=6e-27, Identity=45%"; Hit description= Hypothetical protein CBG05236 [Caenorhabditis briggsae]
  Gene Ontology: Mol. function=protein C-terminus binding; Cellular component=membrane; Biological process=endosome transport
  Coding regions on vcDNA: vcDNA=SeqID_96352; Strand=+; Position=127-504
MIHIAIPSHRTLADHEDPYNKFTVYDIHVNGAFHASVRYNLLYSLHEKLIDLFGFRLNAPDFPPKKLWKLDAKALNERREGLAKYLQGVVANPDVSRHPVMERVFLDFQVKSFSAAVSRMTKLEIF

SEQ ID NO: 169930 - protein, 123 aa, Heterodera glycines
  Homolog annotation: Hit_ID=CAE61387.1; Match level="QueryCoverage =91%, HitCoverage=24%, E-value=4e-25, Identity=46%"; Hit description =Hypothetical protein CBG05236 [Caenorhabditis briggsae]
  Gene Ontology: Mol. function=protein C-terminus binding; Cellular component=membrane; Biological process=endosome transport
  Coding regions on vcDNA: vcDNA=SeqID_96353; Strand=+; Position=65-436
MIHIAIPSHRTLADHEDPYNKFTVYDIHVNGAFHASVRYNLLYSLHEKLIDLFGFRLNAPDFPPKKLWKLDAKALNERREGLAKYLQGVVANPDVSRHPVMERVFLDFQVVSPTFSRSPFLLR

SEQ ID NO: 169931 - protein, 81 aa, Heterodera glycines
  Coding regions on vcDNA: vcDNA=SeqID_96354; Strand=+; Position=215-457
QGQCFLVYNCLGLNYVRGLSPYARKVCRSGGSPPIGLPLLSAKFNWPFGSWPNSVSSSFWHSAAPLFWPMPFLWLFFSSIF

SEQ ID NO: 169932 - protein, 137 aa, Heterodera glycines
  Coding regions on vcDNA: vcDNA=SeqID_96355; Strand=+; Position=84-494
FMTKLISCRRTAIAWEFSPIVFCPLAVISALFFGVGCNANHLYSEGGSFPVLSSDFSPPIPNDPPTFGSPADLLDNELQQPNQQYQTEFAPSMEQMVDEQRRNRLAKIIEQMRDNGQFSQQEIADGPGLFLEEGEAN

SEQ ID NO: 169933 - protein, 146 aa, Heterodera glycines
  Coding regions on vcDNA: vcDNA=SeqID_96356; Strand=+; Position=170-607
SMPRRPKTLNRNGGTSPVSCLGMEVELDAWAAIMNGLQGPAREAEEALFTAFIRDDRHLTEWLEDAREMLAHIAAELADEPNQPIAAGGQQPAVAVNPPVPAVPFVNNAAFLGGANVQQPAAVANHANQPPLVPNNAQIVPNPRFG

SEQ ID NO: 169934 - protein, 110 aa, Heterodera glycines
  Coding regions on vcDNA: vcDNA=SeqID_96357; Strand=+; Position=178-510
FYPSFFSHSRICHRTTNFFFCCCFPGSITSQKASKGHAPTTCAPSVSAWHPHFVVFESLNRIPFPSFSTDDGTGNFFLSAYAMSAQKIASDSEWKKTVGFWGIWPEIFYF

SEQ ID NO: 169935 - protein, 122 aa, Heterodera glycines; identical to SEQ ID NO: 165288
  Homolog annotation: Hit_ID=CAE60185.1; Match level="QueryCoverage =63%, HitCoverage=37%, E-value=2e-16, Identity=58%"; Hit description =Hypothetical protein CBG03741 [Caenorhabditis briggsae]
  Gene Ontology: Mol. function=RNA binding; Cellular component=nucleus; Biological process=locomotory behavior
  Coding regions on vcDNA: vcDNA=SeqID_96358; Strand=-; Position=38-406

SEQ ID NO: 169936 - protein, 90 aa, Heterodera glycines
  Coding regions on vcDNA: vcDNA=SeqID_96359; Strand=-; Position=1-270
ASLPTLIAMVMTMVIFVKIFIKEIFDPSFVDSIFSHTIFHFYIYKPIFFFAFFFVCLSETINFCFEIPSSYIKIYQILSTLDPYKLWPTC

SEQ ID NO: 169937 - protein, 176 aa, Heterodera glycines
  Coding regions on vcDNA: vcDNA=SeqID_96360; Strand=+; Position=3-533
RRHCSLSLPSTTALCQHITAIKKFHCQLNVLTKLNCITRLSLWLKDQIILFISFPKYHYYLYSCGFLGRKSSFSFFTRFVKLLCNTPKVYDDQDVRWSSVRMSVWWCLCSLWSPSPFMCIKELASFCSKKYRNTTTGKESKFQIFLTYRALFAQNTKFSAPNEWSTPKMVMVSLIW

SEQ ID NO: 169938 - protein, 44 aa, Heterodera glycines; identical to SEQ ID NO: 165285
  Coding regions on vcDNA: vcDNA=SeqID_96361; Strand=-; Position=3-134

SEQ ID NO: 169939 - protein, 83 aa, Heterodera glycines
  Coding regions on vcDNA: vcDNA=SeqID_96362; Strand=-; Position=3-251
TRINYLSYSPKNGSSSTCCQGKILVLQKSLLLIMLKRNKINLFLIINNFVGPRFLDSYVLLLFSTGCPCFGIFCASPLFLHIF

SEQ ID NO: 169940 - protein, 97 aa, Heterodera glycines
  Homolog annotation: Hit_ID=XP_392582.1; Match level="QueryCoverage =88%, HitCoverage=17%, E-value=7e-28, Identity=65%"; Hit description =similar to phosphate transporter family member (54.8 kD) (5H667) [Apis mellifera]
  Gene Ontology: Mol. function=sodium:phosphate symporter activity; Cellular component=integral to plasma membrane; Biological process =hermaphrodite genital morphogenesis
  Coding regions on vcDNA: vcDNA=SeqID_96363; Strand=+; Position=187-477
MVVADLAVFQLDLFWTIILGFLIAFVLAFAIGANDTANSFGTSVGSRVLTLQQAYLLASIFETMGAALLGYQVTDTMRKGVIDLNIYEGREKELMLG

SEQ ID NO: 169941 - protein, 51 aa, Heterodera glycines
  Coding regions on vcDNA: vcDNA=SeqID_96364; Strand=+; Position=1-156
KRANSPNFILPLHLLILSSPMLSHSFAEVILTNKKDRQQKETPFVHLFASH

SEQ ID NO: 169942 - protein, 108 aa, Heterodera glycines
  Homolog annotation: Hit_ID=AAC33318.1; Match level="QueryCoverage =100%, HitCoverage=9%, E-value=2e-16, Identity=40%"; Hit description =pol polyprotein [Drosophila virilis] pir||T13933 pol polyprotein - fruit fly (Drosophila virilis) retrotra
  Coding regions on vcDNA: vcDNA=SeqID_96365; Strand=+; Position=32-355
FGRAFTIECDASKKAIGAVLLQENGPVAYISRALNRHETNYPSIEREALALVYAVKEFSPYIVGSGVTKVITDCSALTGMMKAKELKGRLEKYQVTLQSFELEIIYRP

SEQ ID NO: 169943 - protein, 200 aa, Heterodera glycines
  Homolog annotation: Hit_ID=CAE65122.1; Match level="QueryCoverage =99%, HitCoverage=31%, E-value=4e-63, Identity=55%"; Hit description =Hypothetical protein CBG09987 [Caenorhabditis briggsae]
  Gene Ontology: Mol. function=chaperone activity; Cellular component =integral to membrane; Biological process=fertilization (sensu Animalia)
  Coding regions on vcDNA: vcDNA=SeqID_96366; Strand=+; Position=11-610
WIPRAAGFRHEGAEEAISKYNGEWQIGSPTDEILANDYGLIVRTKARHHAISARLRKPFKFDGSPLVVQYEVKYEQGQECGGGYLKLLRDDASKDLKQFNDKTPYVIMFGPDKCGMTSKVHLILKHKNPKNGTISEHHAKQPSKSLSNYFEDKKNHLYTLVIRPDNAFSVSVDHTEIMSGNLLTDLEPSVVPPKQIPDPE

SEQ ID NO: 169944 - protein, 53 aa, Heterodera glycines
  Coding regions on vcDNA: vcDNA=SeqID_96367; Strand=-; Position=60-221
LSHNICGAFGFSVQLFFSDRQQMNESFQFHRFLSVRPSILLPFYPIIHFRFIK

SEQ ID NO: 169945 - protein, 115 aa, Heterodera glycines
  Coding regions on vcDNA: vcDNA=SeqID_96368; Strand=+; Position=1-345
LRFGFICFRMLFVLFFCHHFLLKIFFTMAFPIAFSIFGIFSVLFGNKNDGPKLRVKRSSSVASSASAAGAIAGGANANSNANNAFASFYADDDNTVLCCVCPAPMTLGDLKKSSS

SEQ ID NO: 169946 - protein, 66 aa, Heterodera glycines; identical to SEQ ID NO: 165268
  Coding regions on vcDNA: vcDNA=SeqID_96369; Strand=+; Position=45-245

SEQ ID NO: 169947 - protein, 50 aa, Heterodera glycines
  misc_feature (15)..(15): Xaa can be any naturally occurring amino acid
  Coding regions on vcDNA: vcDNA=SeqID_96370; Strand=+; Position=205-354
QHFKNKCIMVSSYIXFISYQKKGLYQGWAKLKNKKRNAKSEICETEKCEM

SEQ ID NO: 169948 - protein, 182 aa, Heterodera glycines
  Homolog annotation: Hit_ID=AAH74544.1; Match level="QueryCoverage =74%, HitCoverage=30%, E-value=9e-09, Identity=28%"; Hit description =LOC447984 protein [Xenopus tropicalis]
  Coding regions on vcDNA: vcDNA=SeqID_96371; Strand=+; Position=1-546
MAIVENIGFSTSNSSAVSSLSFLLRTYFEQLCRDSLNSAINSGRAEVGLDFVSYVFGANGINITELHDYIQQVQPYAADEHPLFPVTEPLNVPPPSSEIADTSERKNGERESAGNDGAEVDEEGNREQNNKHSLNSFNSRSNVRNAISQKIFPNFVGAFAPNLGFSVRKVELPTENVSVDQH

SEQ ID NO: 169949 - protein, 208 aa, Heterodera glycines
  Homolog annotation: Hit_ID=NP_500389.1; Match level="QueryCoverage =51%, HitCoverage=76%, E-value=2e-11, Identity=30%"; Hit description =dorsal interacting protein 3 like (4E403) [Caenorhabditis elegans] gb|AAK68607.1| Hypothetical protein ZC
  Coding regions on vcDNA: vcDNA=SeqID_96372; Strand=+; Position=121-744
MISNLFGTHPLRTEIKKKRPSQRRGNAEEETFHFIIDCHGKFDAKDTRNFNSSLVEEVSRHPALFDFTRDEYKSTEARNRHWAEVAEEMQQSVEFVRTRWKTLRDRFKKEVRRQHQCVEGPIWQHYDKMLYLLPFIRDKDDSTEVGTTVSNGSVGIRSKNGARRAEGPTDNTDRGTTLWHGEREQKRRTNNGNLLHPSPINSCTAAIL

SEQ ID NO: 169950 - protein, 74 aa, Heterodera glycines; identical to SEQ ID NO: 165253
  Coding regions on vcDNA: vcDNA=SeqID_96373; Strand=+; Position=47-271

SEQ ID NO: 169951 - protein, 101 aa, Heterodera glycines
  Coding regions on vcDNA: vcDNA=SeqID_96374; Strand=+; Position=176-478
MNKMGPTSENDGPKKQKKGGRRRDGMPKPTPKPKGMAAASTALRQLSPLHKVLLVVVALLQWTTTGGRAALLQGCDFSEDLCTDGEVCLPDGLFGQCYSDD

SEQ ID NO: 169952 - protein, 36 aa, Heterodera glycines
  Coding regions on vcDNA: vcDNA=SeqID_96375; Strand=-; Position=55-165
IFAESCKSSGIFRIISQKKGTENLIGEVVIAFLIKI

SEQ ID NO: 169953 - protein, 140 aa, Heterodera glycines; identical to SEQ ID NO: 165239
  Coding regions on vcDNA: vcDNA=SeqID_96376; Strand=-; Position=37-459

SEQ ID NO: 169954 - protein, 80 aa, Heterodera glycines
  Coding regions on vcDNA: vcDNA=SeqID_96377; Strand=+; Position=258-497
RANICVNCCSRLRDHQETRRRGRTEAILYYPEGATLFIKLVSNYSFSLYFSLIFQNGDENDGNTTKGKKTTTGPSAAVTR

SEQ ID NO: 169955 - protein, 39 aa, Heterodera glycines
  Coding regions on vcDNA: vcDNA=SeqID_96378; Strand=-; Position=2-118
LIALNHQNFFGGFYRHHRTLKNLNFLGKFLISVFNFCLY

SEQ ID NO: 169956 - protein, 158 aa, Heterodera glycines
  Coding regions on vcDNA: vcDNA=SeqID_96379; Strand=+; Position=1-474
IKWYKMSIIDIDAEQNNHSFAVDSQSNNYFLVGRGGDKSILLNETSGNSYAFSNVPTLPSVHYLFKNNKIHFNGIFSYEIHEFFQCSIDNARTLYSIRDLKEFAKACGGGTELIPFFGYALRIVVEAPIELGTDTKTEEDDGQQQKQWGECATFGSGK

SEQ ID NO: 169957 - protein, 160 aa, Heterodera glycines
  Coding regions on vcDNA: vcDNA=SeqID_96380; Strand=+; Position=3-482
ATVWSKFASQLSSWLSEMPSEKRRGRAETRPNGGDGVAGVRNSRSLSALSRRHNLVRTSKSSENLHRISLLSTATTIGNGQQRQKPFLAQFGLNGPNAHSEEGSVPCQNSRKGSVEGHQSPLTPARTKTRRFPFFGKENETTAAPGGEGESGYSSGSSSR

SEQ ID NO: 169958 - protein, 212 aa, Heterodera glycines
  Coding regions on vcDNA: vcDNA=SeqID_96381; Strand=+; Position=32-667
LATFKTPDNNTKKFCKTKGSPLFKKFSKTRQMERDRILFQRQRFPTVASIHHQPATSSASGVLVPIPTTDGAAAVPGSAGGYQRRYSTHREQQLQQRNRRDSKFSRRLAVYTSPPEDSAAGAISLRPLNTTIISSSPRTGSSSDAELDTDEIANAAATTERRRRLQQRQRRRLSADDGESQVIAASPSRRQLLTQPLTNPDAGLIPQIDKPM

SEQ ID NO: 169959 - protein, 45 aa, Heterodera glycines
  Coding regions on vcDNA: vcDNA=SeqID_96382; Strand=+; Position=341-475
NCTISKWTTNCQPPPSPHYSPWYHSRNIWLKMVVYLKVFGINVTS

SEQ ID NO: 169960 - protein, 191 aa, Heterodera glycines
  Coding regions on vcDNA: vcDNA=SeqID_96383; Strand=+; Position=1-576
LDLSINSTVILRDEWLLLGAQEGLFATPMSPQQLRAPFRIAGVSCVYWMELLPEFDMLLAICGSARQLAVIHLQQIHRAFFVAQQPTVSCTNIANIEQCHIAVVSNSEHHRDKRSFPSPSLFVPSSLIHCLFPFQFRLHCHNRRNCRAPIRRQIGLLFSRRSNQNGGAVHLHLLRFGWFRFRGRQFSFCAI

SEQ ID NO: 169961 - protein, 156 aa, Heterodera glycines
  Coding regions on vcDNA: vcDNA=SeqID_96384; Strand=+; Position=50-517
QKTEYFSDAKRIIDYVLVYEEKEMTNSNYNNNCDDNKQRDNSRSSPNGTHKNSCFSAPSECPFLSRSSCIGTALTTFHGCQCHRRRGERQRKGRRDGRRRAASAQCFPRKIGSFIQCLAQSADQIGGPLIAFPQNFEFGGDFNRTDGTEINGQFQR

SEQ ID NO: 169962 - protein, 149 aa, Heterodera glycines
  Homolog annotation: Hit_ID=CAE57522.1; Match level="QueryCoverage =54%, HitCoverage=4%, E-value=6e-10, Identity=40%"; Hit description =Hypothetical protein CBG00497 [Caenorhabditis briggsae]
  Coding regions on vcDNA: vcDNA=SeqID_96385; Strand=+; Position=108-554
MDFTGGNTPNLFEVLLRNFCSESSSIQEKAVSSIPSIEQRFAEVETNEFKAAFGELSGGTLRLVADDRPSTSSEANDQQYKPIEIVIGDDAEIVQQPSSSSSLISSHPETVQDAKVYARIRELREAGLWSATRLPKCEDPPRRKLHWDY

SEQ ID NO: 169963 - protein, 165 aa, Heterodera glycines
  Homolog annotation: Hit_ID=AAO85274.1; Match level="QueryCoverage =94%, HitCoverage=20%, E-value=2e-51, Identity=55%"; Hit description =chondroitin disaccharide polymerase [Caenorhabditis elegans]
  Coding regions on vcDNA: vcDNA=SeqID_96386; Strand=+; Position=234-728
SICFSPSPQRFLDTRAFQIWRSWARRVPGRVLFFVADGTVLSARVRAARMPVVVLRGVDDAYPPQKKAFAMLRWMFDNQLSNFHWFLRADDDLYVRTDQLKQFLIGMDPDRAHFIGQAGLGNSLEYGQLSLGAQDNYCMGGPGVLLSRETLRQLGPHLENCLRHL

SEQ ID NO: 169964 - protein, 160 aa, Heterodera glycines
  misc_feature (79)..(79): Xaa can be any naturally occurring amino acid
  Homolog annotation: Hit_ID=AAR06638.1; Match level="QueryCoverage =95%, HitCoverage=94%, E-value=2e-53, Identity=63%"; Hit description =superoxide dismutase [Brugia malayi]
  Gene Ontology: Mol. function=copper, zinc superoxide dismutase activity; Cellular component=cytoplasm; Biological process =neurogenesis
  Coding regions on vcDNA: vcDNA=SeqID_96387; Strand=+; Position=108-591
MQKRAAVCVLVGDEDPNVKGKINFIQEKDDSPVTIQGEITGLSPGKHGFHVHAFGDLSSGCMSAGPHFNPTNKTHGGPXDETRHVGDLGNVLAGQDGVAKLDFTDKVISLVGPHNIIGRALVVHKLEDDLGRGEGLKKPESMETGNAGPRLACGVIGIAQ

SEQ ID NO: 169965 - protein, 156 aa, Heterodera glycines
  Homolog annotation: Hit_ID=CAE65006.1; Match level="QueryCoverage =100%, HitCoverage=57%, E-value=1e-61, Identity=68%"; Hit description= Hypothetical protein CBG09844 [Caenorhabditis briggsae]
  Gene Ontology: Mol. function=phosphatidylinositol transporter activity; Cellular component=membrane fraction; Biological process =nonselective vesicle transport
  Coding regions on vcDNA: vcDNA=SeqID_96388; Strand=+; Position=80-547
MIIKEYRLVLPMTVDEYQIGQLFSVAEASRQETGGGEGVQVLRNEPFEGESLFNGQFSSGQYTHKIYHFDSKVPSLLRAIMPKGSMSVHEHAWNAYPYCKTELTNPDFMKDSFFIRIETIHLNDRGTTENALCLTTDMLSKREVVRIDIANDKEFI

SEQ ID NO: 169966 - protein, 113 aa, Heterodera glycines
  Homolog annotation: Hit_ID=CAE65006.1; Match level="QueryCoverage =100%, HitCoverage=41%, E-value=7e-46, Identity=71%"; Hit description= Hypothetical protein CBG09844 [Caenorhabditis briggsae]
  Gene Ontology: Mol. function=phosphatidylinositol transporter activity; Cellular component=membrane fraction; Biological process =nonselective vesicle transport
  Coding regions on vcDNA: vcDNA=SeqID_96389; Strand=+; Position=2-340
EYQIGQLFSVAEASRQETGGGEGVQVLRNEPFEGESLFNGQFSSGQYTHKIYHFDSKVPFLLRAIMPKGSMSVHEHAWNAYPYCKTELTNPDFMKDSFFIRIETIHLNDRGTT

SEQ ID NO: 169967 - protein, 159 aa, Heterodera glycines
  Homolog annotation: Hit_ID=NP_509832.1; Match level="QueryCoverage =93%, HitCoverage=25%, E-value=2e-11, Identity=30%"; Hit description =astacin and metridin-like ShK toxin family member (XL580) [Caenorhabditis elegans] emb|CAA91996.1| Hypoth
  Coding regions on vcDNA: vcDNA=SeqID_96390; Strand=+; Position=3-479
MDKDVKPEDPSVSFGFLSEEAREAMLKNCLSGAVDCKAQPFGMIQKRTMVLQHEMDFMRKVRPYQSGEMVQKRVEMVQKLKQKMLEVAGLDEHVQPVNDGTFQHDVLLTEKQSEELIKALNNVPKPAKKLHRYGYGHRFKRASLFLEQFAAQKWPIGQP

SEQ ID NO: 169968 - protein, 158 aa, Heterodera glycines
  Homolog annotation: Hit_ID=NP_741261.1; Match level="QueryCoverage =96%, HitCoverage=16%, E-value=1e-47, Identity=61%"; Hit description =V-ATPase a subunit; ATP-dependent proton pump involved in the acidification of intracellular compartments
  Gene Ontology: Mol. function=hydrogen-transporting ATPase activity, rotational mechanism; Cellular component=integral to membrane; Biological process=negative regulation of locomotion
  Coding regions on vcDNA: vcDNA=SeqID_96391; Strand=+; Position=1-474
EGFVDEHHQQQHISTSVHANMQEDGAEVLHHEDTSPTHKNHETATGGEKGGGQGQQHGDGSFGDIMVYQAIHTIEFALGCISHTASYLRLWALSLAHAQLSDVLWSMVLRNGFVQSGYLGAVITYLIFIVFGTLTLSILVLMEGLSAFLHALRLHWVE

SEQ ID NO: 169969 - protein, 168 aa, Heterodera glycines
  Coding regions on vcDNA: vcDNA=SeqID_96392; Strand=+; Position=1-507
LIRFSSSSTFLLSLLQIHFQISSSKMRCSLLLPLLFVLLPLLANSCISPPKKECCCQPCCQQPQCRHQRSRIITVTISPSSSSSRNQPLRSLSLHSCDTLVNVPVKMGMPWCKSLSNSLLFLSNSVHWLLNSLIILWQLRARMCKFGERERPTEKECLADLFLRYFIH

SEQ ID NO: 169970 - protein, 212 aa, Heterodera glycines
  Homolog annotation: Hit_ID=NP_083307.1; Match level="QueryCoverage =78%, HitCoverage=36%, E-value=3e-22, Identity=37%"; Hit description =carbohydrate kinase-like [Mus musculus] emb|CAI24581.1| carbohydrate kinase-like [Mus musculus] emb|CAI24
  Gene Ontology: Biological process=carbohydrate metabolism
  Coding regions on vcDNA: vcDNA=SeqID_96393; Strand=+; Position=1-636
KEKGQLDGEKWDRAGTIMDFLASLLTQSKSAFISSQNAESWGFVSDYIWTVQQAHFPTHLLPSIVSPGTFIGRTSLPFAHLPKGVPVTVPLGDLQASLLPFLSAGVAALHIGTASQIAFVSQRLAEEMSPKVVLPNSIRRDPFFDDDFLLVAPSLNGGNVFTGLFQQIASWSADLFGFPSDFSPLSFSAAFSLLDRIFNSPNSQPNDGEVPP

SEQ ID NO: 169971 - protein, 165 aa, Heterodera glycines
  Homolog annotation: Hit_ID=AAL78214.1; Match level="QueryCoverage =85%, HitCoverage=73%, E-value=5e-26, Identity=38%"; Hit description =putative esophageal gland cell protein Hgg-20 [Heterodera glycines]
  Coding regions on vcDNA: vcDNA=SeqID_96394; Strand=+; Position=104-598
MSDHPREEKRIFEKIFICNDILLDSLPFCGHAKIGLEFAVVSYRFDVVVDTHLKRRKWKLGSLRIERSSTNDGAEIVKCNSDKTVKRLPIPLKPLPPNLIGFKRIAVYHINRKVIAFLHRIQRLFATDITLELAIFFRQRQSWDVVTYGIWPALNAAGIVKIRFH

SEQ ID NO: 169972 - protein, 161 aa, Heterodera glycines
  Coding regions on vcDNA: vcDNA=SeqID_96395; Strand=+; Position=3-488
AYQNNFPIITHRQFGHSSSAASFLLRRIAVLVLLLLPHNDGSPRLPGPPIFEAISHYPSICYLPPESGMCPPATNRTTDTDHIKVAAATVDDSRATVGEGLAEGDDDASQLRHASTPLLTRYYFDAVTAQCYPFGAQTCGGNENRFETKEKCLTKCRIGTD

SEQ ID NO: 169973 - protein, 160 aa, Heterodera glycines
  Homolog annotation: Hit_ID=CAE69251.1; Match level="QueryCoverage =95%, HitCoverage=66%, E-value=1e-22, Identity=37%"; Hit description =Hypothetical protein CBG15298 [Caenorhabditis briggsae]
  Gene Ontology: Mol. function=v-SNARE activity; Cellular component =Golgi membrane; Biological process=ER to Golgi transport
  Coding regions on vcDNA: vcDNA=SeqID_96396; Strand=+; Position=1-480
VVTSALDDLQRKARLLENEIDAQLISLNKFNPSDALSSYSYNSNQTKGQGKRAVFDSLTTDIENKLSKLSEINDAMRDCFENDMAEFSKTSVQHIVRRHRDILRDYSTEFTRTTSNIGNQLHREELMAIESESSVNNRCKPTDYLLKEHESISSCDRLLN

SEQ ID NO: 169974 - protein, 153 aa, Heterodera glycines
  Homolog annotation: Hit_ID=CAE62536.1; Match level="QueryCoverage =99%, HitCoverage=19%, E-value=3e-34, Identity=51%"; Hit description =Hypothetical protein CBG06645 [Caenorhabditis briggsae]
  Gene Ontology: Mol. function=NADH dehydrogenase (ubiquinone) activity; Cellular component=membrane fraction; Biological process =mitochondrial electron transport, NADH to ubiquinone
  Coding regions on vcDNA: vcDNA=SeqID_96397; Strand=+; Position=1-459
FSKKLENAKHPMIVVGAQAFQGENSSSLLQKLHQLAEKLRSTSQTKQNTKGNGQPKVLNLLHEFAGHVAAFDLGFRPFNELNSEVKRSIKLLYLLGSDEKPISRKEFHPDVFVIYQGHHGDNGAEVADLVLPGGAYTEKEATWVNMEGRAQRG

SEQ ID NO: 169975 - protein, 160 aa, Heterodera glycines
  Coding regions on vcDNA: vcDNA=SeqID_96398; Strand=+; Position=1-480
GKIKLIWPTVAEELQTSAERRRLQRDREQRTKARMAGINRTSTTPDENSKPMELTDKGKTPKLKQQTLSRFFGTMTKNSAPTPVPPMGQQQLQNYTNPKQKQPRKRSSPGSLSTSSSSSIIAISSTSPTAVPDSVSPPFRPLETTGPTNSKATKLHNAEE

SEQ ID NO: 169976 - protein, 185 aa, Heterodera glycines; identical to SEQ ID NO: 162676
  Homolog annotation: Hit_ID=CAE69517.1; Match level="QueryCoverage =100%, HitCoverage=100%, E-value=4e-54, Identity=51%"; Hit description=Hypothetical protein CBG15726 [Caenorhabditis briggsae]
  Gene Ontology: Mol. function=ubiquitin conjugating enzyme activity; Cellular component=proteasome complex (sensu Eukarya); Biological process=protein modification
  Coding regions on vcDNA: vcDNA=SeqID_96399; Strand=+; Position=39-596

SEQ ID NO: 169977 - protein, 120 aa, Heterodera glycines
  Homolog annotation: Hit_ID=NP_001024.1; Match level="QueryCoverage =98%, HitCoverage=13%, E-value=3e-28, Identity=55%"; Hit description =ribonucleoside-diphosphate reductase M1 chain [Homo sapiens] gb|AAH06498.1| Ribonucleoside-diphosphate re
  Gene Ontology: Mol. function=ribonucleoside-diphosphate reductase activity; Cellular component=cytoplasm; Biological process=DNA replication
  Coding regions on vcDNA: vcDNA=SeqID_96400; Strand=+; Position=3-365
QKDILKMAADRAAFIDQSQSLNIHIAQPNYAKLSSMHFYAWSLGLKTGMYYLRTRPAVDAVQFTVDKMALRGTIAKDESVEIDVLKDKENISANSELRLPSKRKYNEQLEESDGCLMCSG

SEQ ID NO: 169978 - protein, 150 aa, Heterodera glycines
  Coding regions on vcDNA: vcDNA=SeqID_96401; Strand=+; Position=26-475
SKVPSLLRTDSKNRKCTDVMALFSLPRQLALFKRTETIVCDGTFKMAPRGIYQIYRVFGFIAQTHCVPLATALLRGKSRVLYDQFWTRLRQELDKIPGILMISQANFDYESASVNAFCDVFPTVRPKMCAFHVKQAINRRIQSMGFMQLY

SEQ ID NO: 169979 - protein, 115 aa, Heterodera glycines
  misc_feature (79)..(79): Xaa can be any naturally occurring amino acid
  Homolog annotation: Hit_ID=CAE64816.1; Match level="QueryCoverage =60%, HitCoverage=10%, E-value=2e-16, Identity=49%"; Hit description =Hypothetical protein CBG09610 [Caenorhabditis briggsae]
  Coding regions on vcDNA: vcDNA=SeqID_96402; Strand=+; Position=50-398
MMEMTILGNRISITADGAKVSPFGSKMDMGDYYVENNKLRKTRGLGWVMAALFVVADMAGGGIVALPTAVVRCQFFSGXLGQCWEILLRRFPVYRTHCRKPYAEIGLKALGPKIR

SEQ ID NO: 169980 - protein, 159 aa, Heterodera glycines
  Coding regions on vcDNA: vcDNA=SeqID_96403; Strand=+; Position=1-477
RREKRSIGKRTTKNLGKKRRKDEAVTAPPVTGVVLPSSTTAAADVPPPPCPSETANGQGPSTTTANAKSTTTTASNSNEHQEKEEATAMLLKMQLGTPVPMSHNVCADKPDYAVEKPALEKWSIGIQAFQHQPPASSTGFFKRMHKIVKSVRKNGPAGV

SEQ ID NO: 169981 - protein, 114 aa, Heterodera glycines
  Coding regions on vcDNA: vcDNA=SeqID_96404; Strand=-; Position=42-386
DQIQIIEQYSHTIGHQSRLSFGFFLLTIHAPILFAHEEAQQRSIFECFKAVRTAGRTSPPMTSTMSVRILHTMMQATLFGAAAALRLVVLPSLRRCAADTRNPRLRWALATYAS

SEQ ID NO: 169982 - protein, 148 aa, Heterodera glycines
  Homolog annotation: Hit_ID=NP_497886.1; Match level="QueryCoverage =89%, HitCoverage=62%, E-value=4e-48, Identity=65%"; Hit description =lysosomal thiol reductase IP30 like family member (3F485) [Caenorhabditis elegans] emb|CAA83624.1| Hypoth
  Gene Ontology: Biological process=regulation of protein activity, epigenetic
  Coding regions on vcDNA: vcDNA=SeqID_96405; Strand=+; Position=61-504
MANSSLSRPFGLCLCSLLLFICAFPPISTQRVNVTLFTESQCPFCTRLLREQIWQFHSRFPGIMNLQVIPFGKGNCEFTRDRRIICKCMHGPTECDLNRLQNCAISYFPRRHIGLVTCIQGLKNLDEAYRRCLSRLSPRTQFRLKQCA

SEQ ID NO: 169983 - protein, 126 aa, Heterodera glycines
  misc_feature (33)..(33): Xaa can be any naturally occurring amino acid
  misc_feature (46)..(46): Xaa can be any naturally occurring amino acid
  misc_feature (83)..(83): Xaa can be any naturally occurring amino acid
  misc_feature (92)..(92): Xaa can be any naturally occurring amino acid
  misc_feature (119)..(119): Xaa can be any naturally occurring amino acid
  Homolog annotation: Hit_ID=CAB88203.1; Match level="QueryCoverage =100%, HitCoverage=40%, E-value=2e-23, Identity=52%"; Hit description= putative cuticular collagen [Globodera pallida]
  Coding regions on vcDNA: vcDNA=SeqID_96406; Strand=+; Position=2-376
QETHIVLGIASLCSLLAIIATVVTLASLYSGDXTNWTTKVRDGVEXAFRVNTDLVWNCPNGTSKNPGTPRKRAGETPINPFFXGKVKFPRNXAFGPPKKEKMAPWPPVGPGDTLGTPKXGGGKNSP

SEQ ID NO: 169984 - protein, 212 aa, Heterodera glycines
  Homolog annotation: Hit_ID=NP_496154.1; Match level="QueryCoverage =100%, HitCoverage=97%, E-value=5e-50, Identity=47%"; Hit description= PRO2290 like (24.1 kD) (2K260) [Caenorhabditis elegans] emb|CAA91349.1| Hypothetical protein R53.5 [Caen
  Coding regions on vcDNA: vcDNA=SeqID_96407; Strand=+; Position=35-670
MAFIGYGALTAALSGIILYANLPTRLTIGAIVPTVEFLAETQLKKLEPGQAVAGPQIKASDLFNAGHPLLVMAVRRPGCAFCRKQASALCSAASTHFADKGVRVVGVVHEQHGVDQFRPFLPCADAIYLDEEKRFFGPSQRWLPLWMGFLRLSTYVNYYKAWKAGFAGNTEGEGRLLRGVYLVNGDNMLFAHLEKQWGDEVKMDKLVDAVSK

SEQ ID NO: 169985 - protein, 160 aa, Heterodera glycines
  misc_feature (151)..(151): Xaa can be any naturally occurring amino acid
  Homolog annotation: Hit_ID=NP_291028.3; Match level="QueryCoverage =76%, HitCoverage=45%, E-value=6e-22, Identity=45%"; Hit description =p53-related protein kinase [Homo sapiens] gb|AAH09727.1| P53-related protein kinase [Homo sapiens] sp|Q96
  Gene Ontology: Mol. function=protein binding; Cellular component =nucleus; Biological process=cell cycle
  Coding regions on vcDNA: vcDNA=SeqID_96408; Strand=+; Position=90-571
MARQIPSARVSAPACSPSNKRIYSPPFSKRWALPFWAQLAEFGHEFGRILRTMHDANLIHGDLTTANVLVLTQRGPVELALIDFGLAQFSSKPGDKAVDLYVLERAIRSAHIGMGKMMDAILDAYKTEGGGGDEDGTNAKPVLLKLDEVRXQGRKRDMIG

SEQ ID NO: 169986 - protein, 141 aa, Heterodera glycines
  Homolog annotation: Hit_ID=XP_308308.1; Match level="QueryCoverage =92%, HitCoverage=27%, E-value=1e-25, Identity=48%"; Hit description =ENSANGP00000010875 [Anopheles gambiae]
  Gene Ontology: Mol. function=heat shock protein activity; Cellular component=mitochondrial inner membrane; Biological process=protein folding
  Coding regions on vcDNA: vcDNA=SeqID_96409; Strand=+; Position=82-504
MLRYVCLFPRRSFHFSTFLPKDYYKILGLSKTAKESDIKKAYYEMAKKYHPDVNKAKGASEKFQELSEAYEVLGDPKRRAEYDRFGAGGPQPGAASGSPGGPQSARDFGWEFHSGKSAEQVFRDIFRDFDPFGNAGAFGSG

SEQ ID NO: 169987 - protein, 188 aa, Heterodera glycines
  Homolog annotation: Hit_ID=NP_493334.1; Match level="QueryCoverage =98%, HitCoverage=49%, E-value=2e-60, Identity=63%"; Hit description =GTP-binding protein like (39.4 kD) (1N870) [Caenorhabditis elegans] emb|CAB07637.1| Hypothetical protein
  Coding regions on vcDNA: vcDNA=SeqID_96410; Strand=+; Position=3-624
VHSILNAQDGVEGRGDCAHGKCGEHLYVPVPLNTLIKKPSTDELRPSKVTLHELCREGDLFIAARGGAGGHGNAFYVSNLVRKPLKAEEGGQGEEMSYDIEMRIMATAGLVGIPNVGKSTLLRAISRAKPKVAAYPFTTLSPSVGMVQYGDFFQLAVADIPGLVQGAHRNEGLGFSFLRHIVRCECVL

SEQ ID NO: 169988 - protein, 143 aa, Heterodera glycines
  Coding regions on vcDNA: vcDNA=SeqID_96411; Strand=+; Position=120-548
MLGMMNCQTENYEFYASPPSSSAPQFRSHQQPDDELFNNRKQKKPQITYTDCRRLIDGKMGEASRQEPTKLWNRVIVDNLTARRLRREQSNRKEEEKATEERDERHKDEEEGEEEEKQREGEEKQGEEMEEAMGTSRKQSEKR

SEQ ID NO: 169989 - protein, 141 aa, Heterodera glycines
  Homolog annotation: Hit_ID=AAK83075.1; Match level="QueryCoverage =99%, HitCoverage=47%, E-value=2e-63, Identity=62%"; Hit description =collagen [Meloidogyne javanica]
  Gene Ontology: Mol. function=structural constituent of cuticle; Cellular component=extracellular; Biological process=positive regulation of body size
  Coding regions on vcDNA: vcDNA=SeqID_96412; Strand=+; Position=3-425
HNGKDGAPGRDAQSIPAPLEEPCIICPPGPAGPQGPAGPKGPPGPKGSPGEPPKDGVPGEQGMQGQPGPVGRPGREGPRGAPGQPGRLIPVPGPQGPPGPSGPPGEQGPKGQPGPDGQSFEGPPGPPGDAGRPGREGRPGG

SEQ ID NO: 169990 - protein, 118 aa, Heterodera glycines
  Coding regions on vcDNA: vcDNA=SeqID_96413; Strand=+; Position=56-412
FLIFLRMTEESVILSFSCLNLPLECSDGCRLVITARSDNDANFVEIGQTETRNGINPKFEARVSLLLRLDKCQQLRIVLYSVDVQSGLLRTLLADAHVLLLALLCAGSKPVAVPLALH

SEQ ID NO: 169991 - protein, 270 aa, Heterodera glycines
  Homolog annotation: Hit_ID=AAG22537.1; Match level="QueryCoverage =92%, HitCoverage=79%, E-value=6e-40, Identity=35%"; Hit description =homocysteine S-methyltransferase-1 [Zea mays] sp|Q9FUN0|HMT1_MAIZE Homocysteine S-methyltransferase 1 (S-m
  Gene Ontology: Mol. function=homocysteine S-methyltransferase activity; Biological process=sulfur amino acid metabolism
  Coding regions on vcDNA: vcDNA=SeqID_96414; Strand=+; Position=33-842
MLSLNGTFPPQSLKPLALAFVLDGGIGSQLEELGYPINNSVIWSGEAIIDAPDLLAKCHKKFIDAGADIIETNSYHVSIQKLMESRGFSLGQAESILHKSVLIAREAIAASGRPVALVGAVGPYATYLRDASEYTGAYVKKPDFQEQTIIDYYLLQCRPLIAAGVTTLNFETIPSVKEVECVAKVMDQLDDTVQAWVCCSCQDGKRTRSGDAFADAVKIANGHPKIVAIGINCTAPDHITELLTEAKKANNSKALVVYPYSGQVYNAETR

SEQ ID NO: 169992 - protein, 194 aa, Heterodera glycines
  Coding regions on vcDNA: vcDNA=SeqID_96415; Strand=+; Position=28-609
IRHNIMTGVCELSEKHSKVRLHLPLELHCELLSALPFEHAARLLLLSKAIAKNCNSLVQKQKKGWKVFSKNCIDKIMKVYHPLVSPTLKSIEEEHHSLEHSEAHQQDTYLNKRIQDSRAELSFFVGANLVRRLAKYETAGQVMTELLNSVVNMHQFIENFKKRMKEMDERFNEVKRLADRIKSDFLPRDIPSQM

SEQ ID NO: 169993 - protein, 107 aa, Heterodera glycines; identical to SEQ ID NO: 165159
  Coding regions on vcDNA: vcDNA=SeqID_96416; Strand=+; Position=1-324

SEQ ID NO: 169994 - protein, 308 aa, Heterodera glycines
  Homolog annotation: Hit_ID=NP_510513.1; Match level="QueryCoverage =75%, HitCoverage=46%, E-value=1e-51, Identity=48%"; Hit description =putative protein, with at least 5 transmembrane domains (XP730) [Caenorhabditis elegans] pir||T20628 hypo
  Coding regions on vcDNA: vcDNA=SeqID_96417; Strand=+; Position=3-926
VLSVLLHHTRHHLSTVTILFIFNILFSNVLFLASFLCLYSDIALDTKYTRPIANSNEEAEEDSADASAEDEDTTTPQLFIAEILQIHLYKPSEFLKNLIQETLLSLAQNGSLLGLTNLLVLVLVVINRSMSGKGIRISRAKVIAVFAGVWLFLVVSHVLFSALQYFAVSQLHELLELTSSNPSQFACRRSATFMVYNEIGERCDRLAVYQELGHFLLRGHTLFTVVLLSISLVIFVITVYCHRRVQRQHHFLNENATNGKNAGGRSDGGTDSEAGGSTVRRRRDSSPFRRRETLFQTLVLSLIAFFLS

SEQ ID NO: 169995 - protein, 114 aa, Heterodera glycines
  Coding regions on vcDNA: vcDNA=SeqID_96418; Strand=+; Position=2-343
EKLCDEFIENGRKLTREYLRKSAKEESAEMFEVFEFVPIDHHGNFDYSLMANLSLPRTSIDSSAGGAFSPNNNPSISNIAINFLADYRPFAYGVPITRDSPSATVISRCKSPFC

SEQ ID NO: 169996 - protein, 167 aa, Heterodera glycines
  Homolog annotation: Hit_ID=CAE73927.1; Match level="QueryCoverage =85%, HitCoverage=76%, E-value=2e-22, Identity=36%"; Hit description =Hypothetical protein CBG21543 [Caenorhabditis briggsae]
  Coding regions on vcDNA: vcDNA=SeqID_96419; Strand=+; Position=22-525
MSLNNSNLLGKRKVALNERRKIYIQRDYSQALVVKFSTDFPEELEHYIDRDIWLNFVTDLNQIYAEAEKLTAIAYLENILGLVTCHLSMLCFKSLWKRKLEEARALLYETNQQNFVRNGVYVCNPLEKGFRVIEVVLLDEPIPLPAVQDEKNEKNSVPKPIVLQPRQ

SEQ ID NO: 169997 - protein, 196 aa, Heterodera glycines
  Homolog annotation: Hit_ID=NP_497039.1; Match level="QueryCoverage =79%, HitCoverage=25%, E-value=2e-65, Identity=72%"; Hit description =putative protein (67.0 kD) (2O915) [Caenorhabditis elegans] emb|CAB07587.1| Hypothetical protein C38C6.6
  Coding regions on vcDNA: vcDNA=SeqID_96420; Strand=+; Position=36-623
MAKGSLNETKDTEFEAHNDCFDFGLNPAAQDSVHINRLAMNYWQKQGAIDVWMKFFERAPNRAEMEKFFFSQLDNPLLGKAFKLAIIGEWLAANSLDQGSYTPTNSELLEFWVSKRAPDRLLACEHGVVDYEIEGSKVKTNVLFEAATTAGNLPNIFKDKKCATFEKLQEERFKQEVHEFKQRGSGGGIIGSIGNF

SEQ ID NO: 169998 - protein, 260 aa, Heterodera glycines
  Homolog annotation: Hit_ID=NP_506599.1; Match level="QueryCoverage =80%, HitCoverage=45%, E-value=6e-78, Identity=64%"; Hit description =histone deacetylase, abnormal GONad development GON-10 (52.1 kD) (hda-1) [Caenorhabditis elegans] emb|CAB
  Gene Ontology: Mol. function=apoptosis inhibitor activity; Cellular component=cytoplasm; Biological process=chromatin modification
  Coding regions on vcDNA: vcDNA=SeqID_96421; Strand=+; Position=2-784
PSIYGITDETYQLIFPLIMRKVMEVFQPSAVVLQCGADSLNGDRLGPFNLTLKGHGKCVKFFRDCNLPLMLLGGGGYTPRNVARCWTYETSLAVDIDISDELPYNDYFEYFAPNYRLHIDASNETNHNTEEYLRTVQNSVLENLSNLSHVPSVQMQPIPRDGMQIDESVEHDRANPDRRLPAEVSDHMTAHPGEFYEGENEGEDRRNRQEYKRRGGNTTGEPSDSREDKQDNSKRIKIEKQPKAEQQEDGELLEEDANTN

SEQ ID NO: 169999 - protein, 212 aa, Heterodera glycines
  Homolog annotation: Hit_ID=NP_509294.1; Match level="QueryCoverage =86%, HitCoverage=42%, E-value=9e-42, Identity=43%"; Hit description =DeHydrogenase, Short chain (48.0 kD) (dhs-29) [Caenorhabditis elegans] gb|AAK68350.1| Dehydrogenases, sho
  Gene Ontology: Mol. function=catalytic activity; Cellular component =cytoplasm; Biological process=estrogen metabolism
  Coding regions on vcDNA: vcDNA=SeqID_96422; Strand=+; Position=3-638
DIVLCSAALLYVVPILELNDADIQRSMDVNAMGTINTIRVFLPEMEARGKGHIVAMGSIASHFGEVFQMAYSPTKFAVRGAMECLRVELRERGLEDILCTTIYPFYVRTPMVTSKGLRPVARWLPFLTVEECAKSVVDAILKEKVNACIPWWLNSFVALNGIFGINMNNVSRDFLDIHFEPSNYEDGQKSFGRIRNSGEIGRKRRQKRGQYK

SEQ ID NO: 170000 - protein, 244 aa, Heterodera glycines
  Homolog annotation: Hit_ID=XP_320498.1; Match level="QueryCoverage =88%, HitCoverage=71%, E-value=2e-28, Identity=37%"; Hit description =ENSANGP00000015808 [Anopheles gambiae]
  Gene Ontology: Cellular component=CCR4-NOT core complex; Biological process=regulation of transcription, DNA-dependent
  Coding regions on vcDNA: vcDNA=SeqID_96423; Strand=+; Position=81-812
MLMPQRQLRLVSKSLLFVHGAGAKQFLQGLTTKDMDSLNNVPLVYSFLLNVRGRILADFFIYRGNNGGNAEAFVLETEKSQAELLEKTLKLYRLRKQIGIEPLLDKTVLFRFDAEGETTQKQKATIPENSSNWMVDPRVPGFGFRAIRKIENETAHDDEASSSAYLRHRLAWGLAEGTEMVDQIPLNMNGDITGGISFEKGCYIGQELVARTHFTGIVRRRLMPFRPIDDKNGRPDFPRRISAG

SEQ ID NO: 170001 - protein, 39 aa, Heterodera glycines
  Coding regions on vcDNA: vcDNA=SeqID_96424; Strand=+; Position=2-118
ALEMIEDLRGAFQQMLVANDWMDSDTREFAMEKAQQMIN

SEQ ID NO: 170002 - protein, 158 aa, Heterodera glycines
  Homolog annotation: Hit_ID=NP_997820.1; Match level="QueryCoverage =99%, HitCoverage=16%, E-value=8e-46, Identity=54%"; Hit description =zgc:65913 [Danio rerio] gb|AAH56710.1| Zgc:65913 [Danio rerio]
  Gene Ontology: Mol. function=pre-mRNA splicing factor activity; Cellular component=nucleus; Biological process=RNA processing
  Coding regions on vcDNA: vcDNA=SeqID_96425; Strand=+; Position=3-476
QILTQQAQFEEARKQYLEGTRRSPHSIAIWLLLIRLEDSRGRHIKARSQLDIAKTKNSKCDQLWLEGIRMELRAGQKELAQSMLARALQECEHSGRLWAEAIFMEQRHARKTKIVDALKKCEHDPNVLLAGSKLVWAERKTKKARSWFQRTVKVDPDF

SEQ ID NO: 170003 - protein, 176 aa, Heterodera glycines
  misc_feature (110)..(110): Xaa can be any naturally occurring amino acid
  Homolog annotation: Hit_ID=NP_506750.1; Match level="QueryCoverage =70%, HitCoverage=38%, E-value=5e-12, Identity=35%"; Hit description =BTB/POZ domain and Meprin/TRAF-like MATH family member (5P667) [Caenorhabditis elegans] emb|CAA21761.1| H
  Coding regions on vcDNA: vcDNA=SeqID_96426; Strand=+; Position=3-534
EVVLKVGPEQFTVSKHFLMSVSPVFHKMFSVDMLEKAQGEVSLEETNGEEFGAFLDAISPKMASPNPANVMGMLKLADRFQVDALRNRCEAHLINCVEISLIERLLCADXYRLEKLKNFILKSLNGVGMREFYEENQAALNLLSKDLLIQLTVRICSSSKIDRSALCHNCTKNLNE

SEQ ID NO: 170004 - protein, 130 aa, Heterodera glycines
  Homolog annotation: Hit_ID=NP_491464.1; Match level="QueryCoverage =92%, HitCoverage=35%, E-value=3e-40, Identity=61%"; Hit description =carbohydrate kinase, PfkB (1F417) [Caenorhabditis elegans] gb|AAK73885.1| Hypothetical protein F57C9.1b [
  Gene Ontology: Mol. function=pyridoxal kinase activity; Biological process=coenzymes and prosthetic group metabolism
  Coding regions on vcDNA: vcDNA=SeqID_96427; Strand=+; Position=2-391
SKERSGKRVLSIQSHVVSGFVGNKCAVFPLQLHGFEVDAINSVQFSNHTQYPNVKGQRLNERDLAELFDGIRNADLPAKYSHILTGYCGDASFLRQIASIVRECRQHNPKLTYVCDPVMGDNGKYYNGIP

SEQ ID NO: 170005 - protein, 148 aa, Heterodera glycines
  Homolog annotation: Hit_ID=NP_492762.1; Match level="QueryCoverage =84%, HitCoverage=21%, E-value=9e-25, Identity=43%"; Hit description =collagen type IV alpha 3 binding protein like (64.7 kD) (1L133) [Caenorhabditis elegans] emb|CAB02094.2|
  Gene Ontology: Mol. function=kinase activity; Biological process =protein amino acid phosphorylation
  Coding regions on vcDNA: vcDNA=SeqID_96428; Strand=+; Position=178-621
MENDQQQSPEDQVSAEAAINLLAVTTTHQHIFGGRNGALFVEIRRIAEQQLEHALAPVDVAGGKWELFVKDGELRMYSRELEVENGIAVDPLKALHVIDGVSAHEFIDLFFRPELKKEWDDTLELGKVVETLSPHTAVIHQIHRRVWP

SEQ ID NO: 170006 - protein, 182 aa, Heterodera glycines
  Coding regions on vcDNA: vcDNA=SeqID_96429; Strand=+; Position=2-547
KLELPAVAAALQQWIPRAAGIGTREKKICLTMELEIFKDACGQTALKLVGRHPITVTASAVPDLPTFETIRVSFFDGFVAAFFTERKKQLSRNRIELAIFSQPTDESKNAFKSLWSLFNSQIGAITSVCNASAADRRNAKNTSIYDLDPYFDTVPDWLVAPTLRRVDGVFGLETIYKWIHND

SEQ ID NO: 170007 - protein, 126 aa, Heterodera glycines
  Homolog annotation: Hit_ID=CAE67485.1; Match level="QueryCoverage =91%, HitCoverage=34%, E-value=6e-43, Identity=74%"; Hit description =Hypothetical protein CBG12990 [Caenorhabditis briggsae]
  Gene Ontology: Mol. function=structural constituent of cuticle; Cellular component=extracellular; Biological process=positive regulation of body size
  Coding regions on vcDNA: vcDNA=SeqID_96430; Strand=+; Position=103-480
MDSQQCPMKETDEHRQMRRIAFVAVVVSTVAVIASVVTLPMLYNYVQSFQSHLMVETDYCKARARDMWLEMTALQIGKGHVNRIKRGWLFGQWVPESGADAYAAGGGPSGGAPSGGAPSSASAPVG

SEQ ID NO: 170008 - protein, 93 aa, Heterodera glycines; identical to SEQ ID NO: 167010
  Coding regions on vcDNA: vcDNA=SeqID_96431; Strand=+; Position=6-287

SEQ ID NO: 170009 - protein, 176 aa, Heterodera glycines
  Homolog annotation: Hit_ID=NP_491709.1; Match level="QueryCoverage =69%, HitCoverage=27%, E-value=2e-35, Identity=50%"; Hit description =tyrosinase family member (82.2 kD) (1G477) [Caenorhabditis elegans] gb|AAB52481.1| Hypothetical protein C
  Coding regions on vcDNA: vcDNA=SeqID_96432; Strand=+; Position=1-531
QVTRGQVCNGGAQSQQNQFRITEKPPAHQAPQCASQGCFNENICCQLWGLAGECRRNPTWMNCFCKVSCGKCIPQDYVFGSCTDYHPRCWEWAEEGECRNNAWMSENCKQSCGTCVSQYELKQMCRRGGRGKRQISMLLEGAAGSPPGGHSEDQKDSLGPPKTAASGAKEFISGQK

SEQ ID NO: 170010 - protein, 156 aa, Heterodera glycines
  Homolog annotation: Hit_ID=NP_956270.1; Match level="QueryCoverage =98%, HitCoverage=68%, E-value=5e-61, Identity=70%"; Hit description =manganese-containing superoxide dismutase precursor [Danio rerio] emb|CAI11702.1| superoxide dismutase 2,
  Gene Ontology: Mol. function=manganese superoxide dismutase activity; Cellular component=mitochondrion; Biological process=superoxide metabolism
  Coding regions on vcDNA: vcDNA=SeqID_96433; Strand=+; Position=1-471
EKTQEALSKGDFRTAIQLQPMLKFNGGGHINHSIFWTVLAKDGGEPSGDLLKTIERDFGSVQKMQEKVSTKAVGVQGSGWSCLGYNKELKRLQVAACMNQDPLEETTGLIPLFGIDVWEHAYYLQYKNVRPDYIKAVWTVVNWKNVEERFMNALNE

SEQ ID NO: 170011 - protein, 143 aa, Heterodera glycines
  Homolog annotation: Hit_ID=CAE62330.1; Match level="QueryCoverage =93%, HitCoverage=13%, E-value=1e-09, Identity=31%"; Hit description =Hypothetical protein CBG06401 [Caenorhabditis briggsae]
  Coding regions on vcDNA: vcDNA=SeqID_96434; Strand=+; Position=113-541
MQQLSDRRIQFLLYIDKKFVKSHAILKLNEKKYGLLTQHVTFEVASKARAMTLSNVLNKMNMKLFGFNYMPMFPQASKSKFNMDGGDVLVIGVDTSRPPKATPFEKFMLRKKGVEGLISEDPLIVGICANYLKNPYKFCGDYY

SEQ ID NO: 170012 - protein, 219 aa, Heterodera glycines
  Homolog annotation: Hit_ID=CAG31935.1; Match level="QueryCoverage =96%, HitCoverage=34%, E-value=8e-41, Identity=45%"; Hit description =hypothetical protein [Gallus gallus]
  Gene Ontology: Mol. function=ATP binding; Cellular component =cytoplasm; Biological process=protein biosynthesis
  Coding regions on vcDNA: vcDNA=SeqID_96435; Strand=+; Position=54-710
MAQSAEKIVFVLGADGDDENGDGSEIKPVKTLLQALRLSHGTSEVDFLRVSVSSKEGQKQWEKPSKSAMKKAISRLEEERRKREKATNSAAAKLTEEAKSVAEQQQEMAREKRLEEAKKMQVKLDESLPEAKRTKIRECPALCGQRVKVFAFVHRMRQQRKNLMFLVLRDGSGFLQCVLNGTLCQTFEALTLTTESSVCVFGQINKLPIGKVAPGGIEL

SEQ ID NO: 170013 - protein, 120 aa, Heterodera glycines; identical to SEQ ID NO: 162626
  Coding regions on vcDNA: vcDNA=SeqID_96436; Strand=+; Position=3-365

SEQ ID NO: 170014 - protein, 210 aa, Heterodera glycines
  Homolog annotation: Hit_ID=CAB88203.1; Match level="QueryCoverage =100%, HitCoverage=70%, E-value=1e-105, Identity=80%"; Hit description=putative cuticular collagen [Globodera pallida]
  Gene Ontology: Mol. function=structural constituent of cuticle; Cellular component=membrane; Biological process=cuticle biosynthesis (sensu Nematoda)
  Coding regions on vcDNA: vcDNA=SeqID_96437; Strand=+; Position=3-632
EMSQMNSKVRDGVEAFRVNTDSAWTDLMDVQVVVTPPSKPRDNPFNSIFRAKRQLPGHCQCAGLQQPSCPPGPPGPSGPPGLFGQPGGAGQPGQPGQPGQPAPPCPPQNIPCPRCPAGPPGRPGGQGPPGQQGAPGQPGTPAQGGGPGTPGAPGPQGQPGQPGRPGAAGQPGQPGANGVVSRPIPGPKGPPGAPGQNGNPGSQGQPGQPG

SEQ ID NO: 170015 - protein, 96 aa, Heterodera glycines; identical to SEQ ID NO: 165128
  Coding regions on vcDNA: vcDNA=SeqID_96438; Strand=+; Position=3-293

SEQ ID NO: 170016 - protein, 118 aa, Heterodera glycines
  Homolog annotation: Hit_ID=AAL00852.1; Match level="QueryCoverage =83%, HitCoverage=12%, E-value=3e-26, Identity=63%"; Hit description =Pctaire class cell cycle kinase protein 1, isoform b [Caenorhabditis elegans]
  Coding regions on vcDNA: vcDNA=SeqID_96439; Strand=+; Position=121-474
MHQMHQSCYAGVAGPNGGPLRPSVSLSVVHESSALGSDGESIEVSPCTSDQSAGGGDGNLGEGRQTTKTEYIPKVKLRQKPNRRWSEQDIQKRLSLPPDIRLPQNVIDKLNRTPTLDN

SEQ ID NO: 170017 - protein, 204 aa, Heterodera glycines
  misc_feature (133)..(133): Xaa can be any naturally occurring amino acid
  misc_feature (153)..(153): Xaa can be any naturally occurring amino acid
  Homolog annotation: Hit_ID=CAE74248.1; Match level="QueryCoverage =90%, HitCoverage=41%, E-value=4e-49, Identity=52%"; Hit description =Hypothetical protein CBG21934 [Caenorhabditis briggsae]
  Gene Ontology: Cellular component=extracellular space
  Coding regions on vcDNA: vcDNA=SeqID_96440; Strand=+; Position=19-630
MLFSPSTVLLLLLIVLPFSLSFILIPQNVRQISPALSSRPFRRFGHFSVIAKRNPIVLIPGDGGSRLKANLTGKPSVVHYFCQRQTNDFFALWLDLQQFGPFVIDCWADNMRLNFNRTSGRAQDLEGVKVRVXGFGHTRTVEWIDSSKRVAEXGYFAPIVASLAKLGYQRGIDVIGAPYDWRRAPEELLHYFVKLRSLIEQLYH

SEQ ID NO: 170018 - protein, 254 aa, Heterodera glycines
  Homolog annotation: Hit_ID=NP_493175.1; Match level="QueryCoverage =64%, HitCoverage=44%, E-value=1e-23, Identity=39%"; Hit description =predicted CDS, zinc finger protein EZNF (1N119) [Caenorhabditis elegans] emb|CAB05558.1| Hypothetical pro
  Gene Ontology: Mol. function=RNA polymerase II transcription factor activity; Cellular component=nucleus; Biological process=regulation of transcription, DNA-dependent
  Coding regions on vcDNA: vcDNA=SeqID_96441; Strand=+; Position=1-762
INDRPYHCRYCPKRFTQKSHLDQHERIHTGLKPFTCQYCGRQFRQRSQQLGHEATHMNRERHSMGSMAMSAAVLGGLVGAAGGYGDAALCGTARERTTHLALKQPQQQQQEMAQAAAAQLTADEQRRQQQQQQSSSPTRPLGLGRPTVAGGVGGNGTRHFQRSQQQQMHQQQTNMDQCCAGDNTSPMAHAQQQHQMNSFNGLLRAVQSNDSAAVDGLLGLRGSMAMKQQQQQHGHSGMELNEQLQLVSAQLMNR

SEQ ID NO: 170019 - protein, 80 aa, Heterodera glycines; identical to SEQ ID NO: 162554
  Coding regions on vcDNA: vcDNA=SeqID_96442; Strand=+; Position=45-287

SEQ ID NO: 170020 - protein, 62 aa, Heterodera glycines; identical to SEQ ID NO: 163764
  Homolog annotation: Hit_ID=AAK95156.1; Match level="QueryCoverage =100%, HitCoverage=100%, E-value=1e-19, Identity=71%"; Hit description=ribosomal protein L29 [Ictalurus punctatus]
  Gene Ontology: Mol. function=heparin binding; Cellular component =cytosolic large ribosomal subunit (sensu Eukarya); Biological process=protein biosynthesis
  Coding regions on vcDNA: vcDNA=SeqID_96443; Strand=+; Position=91-279

SEQ ID NO: 170021 - protein, 159 aa, Heterodera glycines
  Homolog annotation: Hit_ID=NP_498209.1; Match level="QueryCoverage =100%, HitCoverage=30%, E-value=8e-51, Identity=58%"; Hit description= biogenic Amine Synthesis related (58.3 kD) (bas-1) [Caenorhabditis elegans] gb|AAV58886.1| Biogenic amin
  Gene Ontology: Mol. function=aromatic-L-amino acid decarboxylase activity; Biological process=dopamine biosynthesis from tyrosine
  Coding regions on vcDNA: vcDNA=SeqID_96444; Strand=+; Position=3-479
HSSVDKGIMLSGVKMRKLPTNREKGGNFVLRAEVLEAAIKEDKANGLTPFILVVTVGTTNTCAVESCRELGPICNREGIWMHVDAAYAGSFFICDEFRHLSDGVELADSFNFNAHKALMINFDCSPMWFKNGDEAIAFFNVDPVYLKHEHQRDAYDFRH

SEQ ID NO: 170022 - protein, 128 aa, Heterodera glycines; identical to SEQ ID NO: 162609
  Coding regions on vcDNA: vcDNA=SeqID_96445; Strand=-; Position=91-477

SEQ ID NO: 170023 - protein, 150 aa, Heterodera glycines
  Homolog annotation: Hit_ID=NP_504455.1; Match level="QueryCoverage =86%, HitCoverage=22%, E-value=1e-39, Identity=59%"; Hit description =nuclear Hormone Receptor (64.6 kD) (nhr-47) [Caenorhabditis elegans] gb|AAC19212.2| Nuclear hormone recep
  Gene Ontology: Mol. function=RNA polymerase II transcription factor activity; Cellular component=nucleus; Biological process=blood coagulation
  Coding regions on vcDNA: vcDNA=SeqID_96446; Strand=+; Position=105-554
MSSISPANPKKFSIPSETNCVVCVDIATGNHYSVASCNGCKTFFRRAIVNNRSFICMGNGNCPIDKGVRCACRACRLEKCLQVGMDPNAIQSERDRIGYTKRTRREKLVGFDEGIGHERGDLCAESFASNDADLEESDEDDVIFRDTEPI

SEQ ID NO: 170024 - protein, 116 aa, Heterodera glycines
  Homolog annotation: Hit_ID=NP_492382.2; Match level="QueryCoverage =97%, HitCoverage=98%, E-value=5e-29, Identity=53%"; Hit description =Janus/Ocnus (13.2 kD) (1J389) [Caenorhabditis elegans] emb|CAB03070.2| Hypothetical protein F36A2.8 [Caen
  Gene Ontology: Mol. function=phosphohistidine phosphatase activity; Cellular component=cytosol; Biological process=dephosphorylation
  Coding regions on vcDNA: vcDNA=SeqID_96447; Strand=+; Position=9-359
MSILQKLSPVNIDSKGVFKYILIKASDGAIERFLVRGYGRCKFHADILEEVQASEGEKAIEFSCVGGGRIKHEPEAKRIFVYGYSQGFGRADHAKSVEILRERYPNYTIEWSNEGY

SEQ ID NO: 170025 - protein, 151 aa, Heterodera glycines
  Coding regions on vcDNA: vcDNA=SeqID_96448; Strand=+; Position=28-480
MSSNLMGSPSCFFHPTAEQAAAAEEVDKYEVFSWHGDLSDQLAAQFLVTDQQLLKECREKLANSELRETKLLSKNGELNAENKALKAELEKQKMMTEHSQIKAKVEKMEQENQQQLDKKYVSFDVFNALVERIKRLENQQLKQNKEEGKKV

SEQ ID NO: 170026 - protein, 39 aa, Heterodera glycines
  Coding regions on vcDNA: vcDNA=SeqID_96449; Strand=-; Position=30-149
SLKILILVNYLRFLNFLKFCSLIFSEGCVLRSAPILIDF

SEQ ID NO: 170027 - protein, 161 aa, Heterodera glycines
  Homolog annotation: Hit_ID=CAA82344.2; Match level="QueryCoverage =96%, HitCoverage=30%, E-value=2e-52, Identity=63%"; Hit description =Hypothetical protein C07A9.6 [Caenorhabditis elegans] sp|P34317|YKT6_ CAEEL Hypothetical protein C07A9.6 in
  Coding regions on vcDNA: vcDNA=SeqID_96450; Strand=+; Position=2-484
RLSPLLFLSVLTFSVRSLRILQIVPGFTNSHVLFNYRLAQTLADMGHSVTLWTQMEMAMVFAGDLKLPEGVIEHRVPIHFRDRLKVEGLKVFQEMIFARGTPYELWWTGREFQEMRLEACEQMLNEADALRQKWAKFDLAIGHFHDLCPVMLAERVGVKRV

SEQ ID NO: 170028 - protein, 77 aa, Heterodera glycines
  Coding regions on vcDNA: vcDNA=SeqID_96451; Strand=+; Position=289-522
INFFPSSPKRSIGKVRLCSNSLNKNASSYIFRFSANSAGASALHFLKKMTKKSYFSKLKSLLNREETEDRLDFCSNK

SEQ ID NO: 170029 - protein, 89 aa, Heterodera glycines
  Coding regions on vcDNA: vcDNA=SeqID_96452; Strand=-; Position=0-266
NHANFVGFVVKLCPKFAFKPVPVMFMFDYSPIAPFFTSAYCFSNHFRCASLIIDGNFIYFFFSFFSSNFCHFSFRAALCLYRAVLHVLT

SEQ ID NO: 170030 - protein, 270 aa, Heterodera glycines
  Homolog annotation: Hit_ID=NP_999734.1; Match level="QueryCoverage =82%, HitCoverage=31%, E-value=4e-18, Identity=26%"; Hit description =katanin p80 subunit [Strongylocentrotus purpuratus] gb|AAC09329.1| katanin p80 subunit [Strongylocentrotu
  Gene Ontology: Mol. function=general RNA polymerase II transcription factor activity; Cellular component=transcription factor TFIID complex; Biological process=establishment and/or maintenance of chromatin architecture
  Coding regions on vcDNA: vcDNA=SeqID_96453; Strand=+; Position=58-908
MVASSFSNNGKNILESPFKLTGECKLLYYCTNELGHFLNQTSNALIGNPLRIVPFDGLSSPQKQVCTNTSNSLEFNCTERYISLTNGTALWIYDLQKGSTLRELHDHDGNISGVAWHRQSPWLLASVGDDCTLRLWDLRSHPAQIAIRRATKPYRRLEFSPDCNYIACAGELVSIYDLCMAQNVVHMLSCSSSSAVRFNPSECLLATADDDRTVRFWDVDTGECVTQTPIFNAKIGQIHFEPNGKYLIAVTEKQMASIRWEPFELVSQFD

SEQ ID NO: 170031 - protein, 132 aa, Heterodera glycines
  Coding regions on vcDNA: vcDNA=SeqID_96454; Strand=+; Position=3-401
SVQGGQSTGEQRRGGKIFLGLAQDAPHVQRVFEADQKRRLYIRRSVSSSTSTARRCCNTTAATALCAAAVVLLPADPTAAERWQHSIVTVWRALPTANAVPRRRNGAMDATPEPIAATVRRLPTEFVLTNEQ

SEQ ID NO: 170032 - protein, 95 aa, Heterodera glycines
  Coding regions on vcDNA: vcDNA=SeqID_96455; Strand=+; Position=200-484
SVSLVLGHQVMNNNDMQLLMNRFKEASQRGSNDEVERFFSDLRKTPHMFNAFLKLTKKQGVCISGDPFPHQHQPQGGAATQPQQQHFVQPQSSFY

SEQ ID NO: 170033 - protein, 322 aa, Heterodera glycines
  Homolog annotation: Hit_ID=NP_502691.1; Match level="QueryCoverage =100%, HitCoverage=64%, E-value=8e-56, Identity=39%"; Hit description= selenium binding protein like (52.4 kD) (4O819) [Caenorhabditis elegans] emb|CAA19490.1| Hypothetical pr
  Coding regions on vcDNA: vcDNA=SeqID_96456; Strand=+; Position=40-1005
MFVALPNCSSPRNPLATYPDCIASLDINPDSQTYGKLISVLEMPNEGDELNNLCCCSSDRLIVTSIGSGRIYVVDTSDPKELKLEKTIEPSTLTSLGVSCPGRVCCASDSVIVGTMGDDRMENNGNFLLLDRLTFEPIGFWAEKEGQKGTKFGGTDFCIQTKQNVLLSVGWGTPAKFRGGLRPRDVTNGHYSNEVNVWEWRQRRLIQTIALEGDCGWMPMAVRFLHNADKCHAFVCTLLGSAIYHLWREEGEESFRHCLAAHIPPKKVDGWQCPSFVPQFVQDLLVSMNWALPKMPAFISDLVISSDDRFLFSSNWLHGDVR

SEQ ID NO: 170034 - protein, 49 aa, Heterodera glycines
  Coding regions on vcDNA: vcDNA=SeqID_96457; Strand=+; Position=1-150
NTSSSTSATDSSPDGGNYIKEEMLQREVKLFQIISKILTLYKSTMGITG

SEQ ID NO: 170035 - protein, 163 aa, Heterodera glycines
  Coding regions on vcDNA: vcDNA=SeqID_96458; Strand=+; Position=1-492
RRLNFNPYNRPFNMRNSGTKRRRAVQQQRHHHLVKRWNFAINARTDTLETCPDAFHRRATDGNDSAQFASHQRHPPTRKKVYLKSSRLPFLNHRQQLATDAPPLQNGLSSIAAAVLSSIESVANERDFMCEWLMQSEGDDDWSDEEGTAAGPIEPCARCAGGI

SEQ ID NO: 170036 - protein, 59 aa, Heterodera glycines
  Coding regions on vcDNA: vcDNA=SeqID_96459; Strand=-; Position=77-256
EVPKVDCLKGVDGIVAEKGDDNGDEEDDCNGCSSTEREEEEEEVHGEEAEGNDGIGILL

SEQ ID NO: 170037 - protein, 298 aa, Heterodera glycines
  misc_feature (82)..(82): Xaa can be any naturally occurring amino acid
  Homolog annotation: Hit_ID=AAK29898.3; Match level="QueryCoverage =98%, HitCoverage=55%, E-value=2e-78, Identity=52%"; Hit description =C-terminal src kinase protein 1 [Caenorhabditis elegans] dbj|BAC76831.1| CSK-1 [Caenorhabditis elegans]
  Gene Ontology: Mol. function=protein C-terminus binding; Cellular component=cytoplasm; Biological process=regulation of cell cycle
  Coding regions on vcDNA: vcDNA=SeqID_96460; Strand=+; Position=105-996
MEADFHAPWFYGSLSREKTEKCLQSCADGTFLIRNSTNYPGDFTLCVACNLRVEHYRIYMVNDHFTCDKEELFDTLTQLVSXSHYKRDADGLCHRLVCPYISEECQRQRTHIDLVLVEERKKEFEQAALLLSVDHLRLGTVIGHGEFGDVLSGTYRGRKVAVKTLNIGMVQDLLAEARFMIGLHHEKLVFLVGVVIEDPRESEVYMLTEFMANGNLVDFLRSRGRHHVDRPRLVQFAQDVAEGMAFLESRNFVHRDLAARNVLLDDRLGAHIGDLRTPSIGQSARKKSRGKGKFPDQW

SEQ ID NO: 170038 - protein, 143 aa, Heterodera glycines
  Coding regions on vcDNA: vcDNA=SeqID_96461; Strand=+; Position=1-429
AKPTELEEISSDLSTVPTQIHVSIPENLMNFDGTELIDLPIDKCVIVYHCGISYGIEPELWKAKTMEKIDGDQIKQTQEMDTKQLEDYVTVYHHGWYGRFEDEQQQQLIDEEEEQKRQFDKSETDRIALSVEQKKEQLAAVDH

SEQ ID NO: 170039 - protein, 141 aa, Heterodera glycines
  Homolog annotation: Hit_ID=CAE70083.1; Match level="QueryCoverage =65%, HitCoverage=35%, E-value=1e-09, Identity=31%"; Hit description =Hypothetical protein CBG16524 [Caenorhabditis briggsae]
  Coding regions on vcDNA: vcDNA=SeqID_96462; Strand=+; Position=46-468
MSSTIAPVSSADGTAGSAAAVASAGPSSVEPMPPVEQLMEGIEEKCPPSLDQRLNAMDEVDMRIDDLLTVVAEVMAGLDKDKPLSKAKMEELYKKYELKLDEIQRGIAEQLTYMEQVCVGAEHQGSTYHYHQVAQLSAARL

SEQ ID NO: 170040 - protein, 89 aa, Heterodera glycines
  Homolog annotation: Hit_ID=NP_871829.1; Match level="QueryCoverage =98%, HitCoverage=19%, E-value=5e-22, Identity=54%"; Hit description =Arginine-tRNA-protein transferase, N-terminal and Arginine-tRNA -protein transferase, C-terminal (52.7 kD)
  Coding regions on vcDNA: vcDNA=SeqID_96463; Strand=+; Position=2-268
CGYCKFTKRAHDKAKFGLWAHRLTVHHYQWLANLGWRRSGRFLYKPLMGRTCCPQYTITLDVHKFLLSHTQKRVLRTMRDFLRTDQRPK

SEQ ID NO: 170041 - protein, 170 aa, Heterodera glycines
  Coding regions on vcDNA: vcDNA=SeqID_96464; Strand=+; Position=110-622
MAPKCLPLELLFEIVPFIPAEKAVPNALSSCRLLHKLFLPRVIKWKEQLLTDLMSFSAIVNNLSAKVDNLSGVINNHSVKLDNLSGVVNNLSGVVNNLSGVLNNLSGKVDNHSVKLETIEKKMVETTGKAPNETKEAGNGHKAVMGAFHQKNGTIRRALTRNTNVGKGEW

SEQ ID NO: 170042 - protein, 56 aa, Heterodera glycines
  Coding regions on vcDNA: vcDNA=SeqID_96465; Strand=-; Position=55-225
RESILNFWGKIVTPQKIYIIKIHFLTSILCHRSPSVRPLVIVFKEIECNLFFVKNF

SEQ ID NO: 170043 - protein, 162 aa, Heterodera glycines
  misc_feature (68)..(68): Xaa can be any naturally occurring amino acid
  Coding regions on vcDNA: vcDNA=SeqID_96466; Strand=+; Position=2-487
HHITAIKKFHCQLNVLTKLNCITRLSLWLKDQIILFISFPKYHYYLYSCGFLGRKSSFSFFTRFVKLXCYTPKVYDDQDVLCSSVRMSVWWCLCSLWSPSPFMCIKELPQMNGQHQKWSWYLSYGSVLLFGAHHWLLAFKWWMDTIWICTFGWSWAQKCGPA

SEQ ID NO: 170044 - protein, 65 aa, Heterodera glycines
  Coding regions on vcDNA: vcDNA=SeqID_96467; Strand=-; Position=2-196
VILIFLLLSPYFLYGNNSSAISPNKSAACSNSFRIFTIFSSVPLAADVPCPVLSILLIGLTSWCR

SEQ ID NO: 170045 - protein, 164 aa, Heterodera glycines
  Coding regions on vcDNA: vcDNA=SeqID_96468; Strand=+; Position=2-496
WSSPRWRPLFIVDARAAGFRHEATSQKMFFHSPLPRTPVLRRSTLSGSGQVEIGAALRHQLAEVFTPPSNIYQVAPQREQSVDDSGGPSAAETVPLIEHQLLMAYQDQLNNNIVQQQNLYQQHQHNFVAPSILVSSSSMEKSASAQDLAGTAAALIRRHRSASK

SEQ ID NO: 170046 - protein, 36 aa, Heterodera glycines
  Coding regions on vcDNA: vcDNA=SeqID_96469; Strand=+; Position=11-118
NFLKYKPKLFGLFKKELKIFKNFIHLPFDRKSIREP

SEQ ID NO: 170047 - protein, 129 aa, Heterodera glycines
  Homolog annotation: Hit_ID=NP_505065.1; Match level="QueryCoverage =96%, HitCoverage=22%, E-value=2e-36, Identity=58%"; Hit description =serine palmitoyltransferase 2 (62.7 kD) (5I501) [Caenorhabditis elegans] gb|AAA92303.1| Hypothetical prot
  Gene Ontology: Mol. function=serine C-palmitoyltransferase activity; Cellular component=mitochondrion; Biological process=gametogenesis
  Coding regions on vcDNA: vcDNA=SeqID_96470; Strand=+; Position=3-389
NKAAVERTELRGFAPLVDSFEAIYARNCYMRVRDVFERPIGGVPGAKVKLVDRQTDDFCWTFKFPGSQTEVINVSSYNYLGFAQSDGPCAEMAAKAVEKGGLSTCGSALEGGQCSIQSDLEKLVAKFLG

SEQ ID NO: 170048 - protein, 125 aa, Heterodera glycines
  Homolog annotation: Hit_ID=CAE62113.1; Match level="QueryCoverage =91%, HitCoverage=18%, E-value=3e-33, Identity=62%"; Hit description =Hypothetical protein CBG06151 [Caenorhabditis briggsae]
  Gene Ontology: Mol. function=ATP-binding cassette (ABC) transporter activity; Cellular component=mitochondrion; Biological process =transport
  Coding regions on vcDNA: vcDNA=SeqID_96471; Strand=+; Position=164-538
MDYGLGRIRRRRSNYGAMSPTKSVQEVQPVALSWHGLTAVHAKSGRKILDNVSGMADAGQLVALMGASGAGKTTLLNTLLNRNLKSLSVEGQVLVNGHSLGRSITYVSGYVQQDDLFMGTLTVKE

SEQ ID NO: 170049 - protein, 181 aa, Heterodera glycines
  Coding regions on vcDNA: vcDNA=SeqID_96472; Strand=+; Position=1-543
QFSQNASRNLLAPQFPCSTSQFSNVAHYHPSFNPTIASNIYINPSVFNTSHDQSFVLINQLQHLSSKSSQNWHLMVDDFVKKTISVPPRNYPKNRSPSSDSSFPVSHPSTRSNSRNSRKTSPPTRKRRLKHNISQGKRTQRQTKEAHLSKQTMECAKAIGLDSDYLRKIEEQKKLREEIAR

SEQ ID NO: 170050 - protein, 103 aa, Heterodera glycines
  Coding regions on vcDNA: vcDNA=SeqID_96473; Strand=+; Position=10-321
MNFACCCHFSRVAQRYFSSSRKQTEQYLERQANDQYSRRAREHSYRARSAFKLMQINDKMHFIRPGTNNNCESANARLKHSLQDSLRLTRVQRPARGAKCSAS

SEQ ID NO: 170051 - protein, 35 aa, Heterodera glycines
  Coding regions on vcDNA: vcDNA=SeqID_96474; Strand=+; Position=3-110
FIDTTSKTSLTQFILTKFSKNIKLSFFGQKLLKRT

SEQ ID NO: 170052 - protein, 139 aa, Heterodera glycines
  Coding regions on vcDNA: vcDNA=SeqID_96475; Strand=+; Position=3-419
SSLPAERRKQSETDRGRQQSAKSSPTREMAPFFSVFYRGISGISRVTKSQSRSDLLEKDGEREGDKAKAKTTQTHGESRNCTTADKPPHPLTKAKGNCATDGHGVWDKANKKGGIRSKSTADLHAAKAAAAAEGKNWRE

SEQ ID NO: 170053 - protein, 142 aa, Heterodera glycines
  Homolog annotation: Hit_ID=NP_508756.1; Match level="QueryCoverage =86%, HitCoverage=18%, E-value=9e-33, Identity=58%"; Hit description =FYVE type zinc finger containing protein (XE998) [Caenorhabditis elegans] pir||T33568 hypothetical protei
  Coding regions on vcDNA: vcDNA=SeqID_96476; Strand=+; Position=53-478
SAMVPVKSAKEYDRQLDVAVLFSECLTRAIKMGYITKEQIDDCDPNVIISLPRLAIVWGLLFYPGGALNVNVPKEDISEMFRHFHKVLILVRNLLQTLEPSELSKLEQKLVGEHDGLGESCSSVRALEQQIEPFSGRSLNRH

SEQ ID NO: 170054 - protein, 216 aa, Heterodera glycines
  Coding regions on vcDNA: vcDNA=SeqID_96477; Strand=+; Position=35-682
MDGELNQGTDPKIVHRDVIEMFPELDLTQIVSEFGHLSPEGLAGIVIDRMALIPRKKNGTLKRKADNESNDEVLSEYSGGSETAEQLGNLLVDKMLGEMLRSCKVELRSKRAVVDSSAWTGVKTLMIEHFPMVRADFVTKMVRHFEGAIVPTAIACFFVENSFGDKLQKIAPSFNQSFWYKMAIPIQCRGRRLKQAYVSEQLREHFKLYNELMCQY

SEQ ID NO: 170055 - protein, 326 aa, Heterodera glycines
  misc_feature (223)..(223): Xaa can be any naturally occurring amino acid
  Homolog annotation: Hit_ID=AAV38461.1; Match level="QueryCoverage =84%, HitCoverage=45%, E-value=4e-46, Identity=36%"; Hit description =mitogen-activated protein kinase kinase kinase 7 [Homo sapiens]
  Gene Ontology: Mol. function=protein tyrosine kinase activity; Cellular component=cytoplasm; Biological process=TGFbeta receptor signaling pathway
  Coding regions on vcDNA: vcDNA=SeqID_96478; Strand=+; Position=9-990
MKPLKIDVDFPSNSHPTSQELNQDCIPLYEMLEFEELQFPNYYLSEQLGRGAHATVMPCHFHGKPAAAKLFNANVDFKTIQKEAKLLHEFRHENIIELYALFHGTMSGLVLELMEGGSLSELIHQRKSIVYQNCHVINWTFQVAKALEYLHKLSFIHRDVKPSNMLLSLDYVVLKLCDFGTIAKHRTDMTSTCGTAAWMAPEVFRGESYDFRCDVFSLGSLSXEMLAPSPPFADAPELNSLAVLWEVAESGLRPPPIEGVAEPLQQLMVRCWADEPNDRPPIDEVKEMLEALLKQLPHGALSPFVGRLLTGRPSPVDFSPQARTND

SEQ ID NO: 170056 - protein, 175 aa, Heterodera glycines; identical to SEQ ID NO: 165037
  Homolog annotation: Hit_ID=XP_421074.1; Match level="QueryCoverage =88%, HitCoverage=18%, E-value=7e-19, Identity=32%"; Hit description =PREDICTED: similar to Liprin-alpha 1 (Protein tyrosine phosphatase receptor type f polypeptide-interactin
  Gene Ontology: Mol. function=signal transducer activity; Cellular component=cytoplasm; Biological process=cell-matrix adhesion
  Coding regions on vcDNA: vcDNA=SeqID_96479; Strand=+; Position=2-529

SEQ ID NO: 170057 - protein, 154 aa, Heterodera glycines
  Homolog annotation: Hit_ID=NP_508928.2; Match level="QueryCoverage =100%, HitCoverage=13%, E-value=2e-27, Identity=44%"; Hit description= drosophila Discs Large homolog (107.0 kD) (dlg-1) [Caenorhabditis elegans] gb|AAK39197.2| Drosophila dis
  Gene Ontology: Mol. function=protein binding; Cellular component =cytoplasm; Biological process=negative regulation of cell proliferation
  Coding regions on vcDNA: vcDNA=SeqID_96480; Strand=+; Position=149-610
MNWLICDSAAKKSGNVRKGDVLLRVNEVDLQNSTHAQAAQTLKAIPNYSEVQLVLQHLPQEYQRFEEKLERARAEMAQLQQNPQQPPYLPPDAMPPPQQIMPMPIRQDFYVRALFDNDPSRGDAVLPHRSLAFRYGDILHVTSVGDDDWWTARR

SEQ ID NO: 170058 - protein, 198 aa, Heterodera glycines
  Coding regions on vcDNA: vcDNA=SeqID_96481; Strand=+; Position=46-639
NGFSFTRPRYVDHLLQSGCVLFRAFVSRRWPRFDAGVKDHRMYCILLQANITGIVQYTDETNVSRSSNFTVPNGGSTKIAYPGSAKLPSHCGQHQQQMTIEFVPDGFNHTELEADNTWYLTLQFNRTGTKEQGTFLLANYTLDVRFFNVQNASSHYNGTYLYAKAPSFKPEWSATVQNGQPNILTCSKNGLHLDEKSS

SEQ ID NO: 170059 - protein, 88 aa, Heterodera glycines; identical to SEQ ID NO: 164225
  Coding regions on vcDNA: vcDNA=SeqID_96482; Strand=+; Position=58-324

SEQ ID NO: 170060 - protein, 153 aa, Heterodera glycines
  Coding regions on vcDNA: vcDNA=SeqID_96483; Strand=+; Position=18-476
MLLLASLRGPCRRPRVLKTLRSLKVPHFSTMNRDYVIETVNFTSERDSVFKFLQEVFLVNEPITRVIGCTPSDTSPIFDDICEKCSKFDLSFAAKNNDGKILGVLLNAPFKLENIHESYRDIGRMPNKKEFGEEIRNGPFPSQNANRIHAILT

SEQ ID NO: 170061 - protein, 160 aa, Heterodera glycines
  Homolog annotation: Hit_ID=CAE58388.1; Match level="QueryCoverage =64%, HitCoverage=78%, E-value=3e-34, Identity=65%"; Hit description =Hypothetical protein CBG01517 [Caenorhabditis briggsae]
  Coding regions on vcDNA: vcDNA=SeqID_96484; Strand=+; Position=68-550
MFLFLPPSLPSRLCLPFLFLLFYAYFGDGFRRRWRDDSFINRTFKPRRYKLTLSIRNHNVTDVRFFRLIGVDNTADFYVAPGDTFTNTYTVNRKGAWVLFVEFPGNRYAKSQRKMISRDSFPQWMMEVYLFPPDNVGFSEWYKIRRTKKRKRTQRKPKMT

SEQ ID NO: 170062 - protein, 147 aa, Heterodera glycines; identical to SEQ ID NO: 165030
  Coding regions on vcDNA: vcDNA=SeqID_96485; Strand=-; Position=3-443

SEQ ID NO: 170063 - protein, 51 aa, Heterodera glycines
  Coding regions on vcDNA: vcDNA=SeqID_96486; Strand=+; Position=21-173
PGPSCPVKAPRLVRSILKTAFALASGARNEINSKTEEIVFHSLIIGSNTHP

SEQ ID NO: 170064 - protein, 38 aa, Heterodera glycines
  Coding regions on vcDNA: vcDNA=SeqID_96487; Strand=-; Position=76-192
IKLFIIIKQKLKHNKKQIRKESPEIEKEGKKWVFIVQH

SEQ ID NO: 170065 - protein, 211 aa, Heterodera glycines; identical to SEQ ID NO: 162556
  Homolog annotation: Hit_ID=AAC47437.1; Match level="QueryCoverage =100%, HitCoverage=80%, E-value=4e-88, Identity=60%"; Hit description= COL-1
  Gene Ontology: Mol. function=structural constituent of cuticle; Cellular component=extracellular; Biological process=cuticle biosynthesis (sensu Nematoda)
  Coding regions on vcDNA: vcDNA=SeqID_96488; Strand=+; Position=1-636

SEQ ID NO: 170066 - protein, 158 aa, Heterodera glycines
  Coding regions on vcDNA: vcDNA=SeqID_96489; Strand=+; Position=3-476
NATQWIRAELENSWPLEIIRHVKIGIKNPVTDPYSYNYTANLIDDIVSPRGPFGYVSQILVTNDFDRIENFWQRCPASYCAVVKGYKGINFSLFRHKVGHLTRAHKAERWFERNRDKMYDIILKNDKTSDLGTLMRAIEMEIGPVTSPDLFHSYVIAH

SEQ ID NO: 170067 - protein, 160 aa, Heterodera glycines
  Homolog annotation: Hit_ID=CAE60266.1; Match level="QueryCoverage =98%, HitCoverage=16%, E-value=3e-24, Identity=41%"; Hit description =Hypothetical protein CBG03843 [Caenorhabditis briggsae]
  Gene Ontology: Mol. function=translation elongation factor activity; Cellular component=cytoplasm; Biological process=ribosome biogenesis
  Coding regions on vcDNA: vcDNA=SeqID_96490; Strand=+; Position=2-481
SLCRVMSGTLRIGDQLNVLRHSASSEDVWHSVKIGTLFLLMGRELLPVECVPAGRICGVEVSDGRWIGGQTLCSRALAVTEVPRMSWHQKFAEPLVRVTVRPTNAGMAEMEELRSALRQLSVLDSAVRVIEQEDGDLAMLTAGEVHLQKCLEDLKLLGQT

SEQ ID NO: 170068 - protein, 104 aa, Heterodera glycines; identical to SEQ ID NO: 162620
  Homolog annotation: Hit_ID=XP_418962.1; Match level="QueryCoverage =81%, HitCoverage=39%, E-value=5e-09, Identity=41%"; Hit description =PREDICTED: similar to chromosome 6 open reading frame 149; CGI-203 protein [Gallus gallus]
  Coding regions on vcDNA: vcDNA=SeqID_96491; Strand=+; Position=90-404

SEQ ID NO: 170069 - protein, 200 aa, Heterodera glycines
  Homolog annotation: Hit_ID=NP_497750.1; Match level="QueryCoverage =94%, HitCoverage=45%, E-value=1e-59, Identity=58%"; Hit description =tumor suppressor like (3E797) [Caenorhabditis elegans] emb|CAA85493.1| Hypothetical protein C14B1.5 [Caen
  Gene Ontology: Cellular component=cytoplasm
  Coding regions on vcDNA: vcDNA=SeqID_96492; Strand=+; Position=31-630
MRSARVNQRQQIEELAQNSALLQDMTILPHNYNFEIPKTIWKIRTIDAKIVALQFPEGLTMFACVIVDILEKHTGAEFIILGDVTYGACCVDDFTARALGCQLLVHYGHSCLVPIQDTVGIHLLYVFVNIDMGTAHLLDTLRHNFLPTAGDGMEKVPKLALVSTVQFVATLQIVKRELAKDGFDIVIPQCSPMSTGELLG

SEQ ID NO: 170070 - protein, 104 aa, Heterodera glycines
  Homolog annotation: Hit_ID=CAE74225.1; Match level="QueryCoverage =88%, HitCoverage=28%, E-value=1e-25, Identity=48%"; Hit description =Hypothetical protein CBG21909 [Caenorhabditis briggsae]
  Coding regions on vcDNA: vcDNA=SeqID_96493; Strand=+; Position=201-512
LFNTLIKSPCFNEHECCAKWAADGQCESNSEYMSQFCKASCKKCQYSYNMQEECADRHKNCKALSYQMKCDSSWMAENCRKYCNKCNVKRMQTCAGGSPGGEKR

SEQ ID NO: 170071 - protein, 123 aa, Heterodera glycines; identical to SEQ ID NO: 162616
  Coding regions on vcDNA: vcDNA=SeqID_96494; Strand=+; Position=37-408

SEQ ID NO: 170072 - protein, 188 aa, Heterodera glycines
  Homolog annotation: Hit_ID=CAE70835.1; Match level="QueryCoverage =100%, HitCoverage=46%, E-value=8e-83, Identity=72%"; Hit description= Hypothetical protein CBG17615 [Caenorhabditis briggsae]
  Gene Ontology: Biological process=mRNA splicing
  Coding regions on vcDNA: vcDNA=SeqID_96495; Strand=+; Position=46-609
MSMSKSSYTYNRKTFEDAEFPILCETCLGPNPYLRMSKDTHGGECKICERPFTTFRWMPGRGARYKKTEICQTCAKLKNVCQTCLLDLEYGLPVQVRDTALQVKETVPKVGANRDYFIQNVDRALEQTDGTVPYGELAKLTDAGTNEMLRKLARNQPYYNRNLPHICSFFVKGECTRGEECPYRHEKP

SEQ ID NO: 170073 - protein, 116 aa, Heterodera glycines; identical to SEQ ID NO: 163734
  Homolog annotation: Hit_ID=CAE60539.1; Match level="QueryCoverage =92%, HitCoverage=11%, E-value=1e-22, Identity=47%"; Hit description =Hypothetical protein CBG04166 [Caenorhabditis briggsae]
  Coding regions on vcDNA: vcDNA=SeqID_96496; Strand=+; Position=3-353

SEQ ID NO: 170074 - protein, 217 aa, Heterodera glycines
  Coding regions on vcDNA: vcDNA=SeqID_96497; Strand=+; Position=1-651
SLFTMYSNISSSGWVSSDHPQQQIGNFYSYDADPTLSPNGGGYNAYFDYPNQQPAASSSNSNFVPLGSGRPFPHTISQHAQLSFSDNSNANFVPLGSGHFLPERDGDVVCYEDSFEMQKIGRKRRRGRKSGRRARMDIYGAGQPATHDFGEIVNYDDWQQWDNGWGGQQQFEQNEAASNYGQYGIEPSQNYEDYEIYYDNYETDQTKELWQEELEQQ

SEQ ID NO: 170075 - protein, 156 aa, Heterodera glycines
  Coding regions on vcDNA: vcDNA=SeqID_96498; Strand=+; Position=6-473
MVLQKKKKSFSGFKIQNFVYGLDSQISSLDKYLLNFKAKKNGGSCLLSGRTNTGKTLVLESLIQKHFSDDDCDINIRRVDGLSKMTKLFEKLDLEGPVLIVVDHFELFAYKQQQNFLYSILNGSQTLPWFVVLIGTTENSVNLLEKRVKSRFSALR

SEQ ID NO: 170076 - protein, 163 aa, Heterodera glycines; identical to SEQ ID NO: 165000
  misc_feature (104)..(104): Xaa can be any naturally occurring amino acid
  Homolog annotation: Hit_ID=CAE69837.1; Match level="QueryCoverage =96%, HitCoverage=93%, E-value=3e-22, Identity=38%"; Hit description =Hypothetical protein CBG16161 [Caenorhabditis briggsae]
  Coding regions on vcDNA: vcDNA=SeqID_96499; Strand=+; Position=25-516

SEQ ID NO: 170077 - protein, 158 aa, Heterodera glycines
  Homolog annotation: Hit_ID=NP_998184.1; Match level="QueryCoverage =100%, HitCoverage=73%, E-value=1e-57, Identity=69%"; Hit description= zgc:73214 [Danio rerio] gb|AAH71458.1| Zgc:73214 [Danio rerio] gb|AAH59560.1| Zgc:73214 protein [Danio r
  Gene Ontology: Mol. function=chaperone activity; Cellular component =endoplasmic reticulum; Biological process=signal transduction
  Coding regions on vcDNA: vcDNA=SeqID_96500; Strand=+; Position=1-474
VLLLNFAFIFFAFLSSIYAEEEDPKVTHKAFFDISIGGVKKGRIVIGLFGEVVPKTAKNFLELAKGTHGYGYKDSKFHRVIRNFMIQGGDFTRGDGTGGKSIFEGKSFEDENFKLHHYGAGWLSMANAGPDTNGSQFFITTVHTPWLDGRHVVFGKVL

SEQ ID NO: 170078 - protein, 50 aa, Heterodera glycines
  Homolog annotation: Hit_ID=NP_000934.1; Match level="QueryCoverage =86%, HitCoverage=20%, E-value=2e-11, Identity=74%"; Hit description =peptidylprolyl isomerase C [Homo sapiens] gb|AAH02678.1| Peptidylprolyl isomerase C [Homo sapiens] sp|P45
  Gene Ontology: Mol. function=cyclosporin A binding; Cellular component=cytoplasm; Biological process=signal transduction
  Coding regions on vcDNA: vcDNA=SeqID_96501; Strand=+; Position=1-150
RLVASKKGRIVIGLFGEVVPKTAKNFLELAKGTHGYGYKDSKFHRVIRNF

SEQ ID NO: 170079 - protein, 66 aa, Heterodera glycines; identical to SEQ ID NO: 133131
  Coding regions on vcDNA: vcDNA=SeqID_96502; Strand=+; Position=39-239

SEQ ID NO: 170080 - protein, 118 aa, Heterodera glycines
  Homolog annotation: Hit_ID=EAA00491.2; Match level="QueryCoverage =96%, HitCoverage=51%, E-value=3e-19, Identity=45%"; Hit description =ENSANGP00000014102 [Anopheles gambiae str. PEST]
  Gene Ontology: Mol. function=structural constituent of cuticle; Cellular component=extracellular; Biological process=cuticle biosynthesis (sensu Nematoda)
  Coding regions on vcDNA: vcDNA=SeqID_96503; Strand=+; Position=6-359
LAAVAALAHLNPPGCRYQNEAETPGPPGPSTETPGPQSSTSTPSEGPGTPSTETPGPPGPSTETPGPPGPSTETPGPPGPSTETPGPPGPSTETPGPPGPSFFLSGPPGPSTETPGPE

SEQ ID NO: 170081 - protein, 162 aa, Heterodera glycines
  Homolog annotation: Hit_ID=NP_872044.1; Match level="QueryCoverage =91%, HitCoverage=7%, E-value=6e-28, Identity=45%"; Hit description =n/apple PAN (2L509) [Caenorhabditis elegans] emb|CAD59157.1| Hypothetical protein T06D8.1b [Caenorhabditis
  Coding regions on vcDNA: vcDNA=SeqID_96504; Strand=+; Position=1-486
EVILAAETVYDCVHSCYQQNCSRAAFTHFPRSVCLMHFGGEVPLDQKCAEVDRLGTTWDFSSVPEVVEIKCVKCAGRKESVEKSTDNEQNIAKRHFSNDENAVGQQETTARHILNPQGLTLKCDGRVEFVASPVANLHPLNITNDVPADTAADCARKCFEAI

SEQ ID NO: 170082 - protein, 91 aa, Heterodera glycines
  Coding regions on vcDNA: vcDNA=SeqID_96505; Strand=-; Position=168-443
RRFRIRLIFENSPSSGVEVLATFCCSSSSVLNSLLSVFFVAFSTVPSFVFLTEFSDEMINCVVGSDALEDDATSWVFSHPSDARMSPSSGR

SEQ ID NO: 170083 - protein, 169 aa, Heterodera glycines
  Homolog annotation: Hit_ID=CAE72242.1; Match level="QueryCoverage =39%, HitCoverage=21%, E-value=2e-20, Identity=75%"; Hit description =Hypothetical protein CBG19360 [Caenorhabditis briggsae]
  Gene Ontology: Mol. function=transcription co-repressor activity; Cellular component=nucleus; Biological process=negative regulation of transcription from Pol II promoter
  Coding regions on vcDNA: vcDNA=SeqID_96506; Strand=+; Position=2-508
LSSAVTHSLPTHPSTPHKIICPLLGDIRASDGTQEAASSSSASDPTTQLIISSLNSVRKTNEGTVENATKKTDNKELSTDEDEQQNVASTSTPEDGEFSKISRIRKRRYSQARIQPTRVKKVMQSDEDIGRMVASVPVAIGSAMEVFAEKLLLAAAESVQHSSTKTLSP

SEQ ID NO: 170084 - protein, 91 aa, Heterodera glycines; identical to SEQ ID NO: 164990
  Coding regions on vcDNA: vcDNA=SeqID_96507; Strand=+; Position=39-314

SEQ ID NO: 170085 - protein, 66 aa, Heterodera glycines
  Coding regions on vcDNA: vcDNA=SeqID_96508; Strand=-; Position=145-345
ATTQGIRLTKPQRGRIKVRHERWINPKSIKATAFPPKPLPKGRHLKLIKLFFNDYNLLGNVRFSPL

SEQ ID NO: 170086 - protein, 120 aa, Heterodera glycines
  Homolog annotation: Hit_ID=NP_499279.1; Match level="QueryCoverage =100%, HitCoverage=48%, E-value=7e-46, Identity=70%"; Hit description= UNC50 (3L404) [Caenorhabditis elegans] pir||T24631 hypothetical protein T07A5.2 - Caenorhabditis elegans
  Gene Ontology: Cellular component=membrane; Biological process =intracellular protein transport
  Coding regions on vcDNA: vcDNA=SeqID_96509; Strand=+; Position=1-360
DFEFAAWQMLYLLVNPQKVYRNFMYRKKAKDQWARDDPAFLLLLALSLLGSSVLFALALNLSFSSFCAFFLWVVFIDCIGIGIAIATALWFISNRFLRRTRDCDVVEWAYCFDVHLNAFF

SEQ ID NO: 170087 - protein, 88 aa, Heterodera glycines
  Coding regions on vcDNA: vcDNA=SeqID_96510; Strand=-; Position=190-456
LLQLPKKSVRRQLLHFFSLHFTNKIIHRSIFRIYSLNISTKFTHPQNAPQLAPHSCNKFVRNLLIQPAVRSRENYILEKMLLSFHKKM

SEQ ID NO: 170088 - protein, 89 aa, Heterodera glycines
  Coding regions on vcDNA: vcDNA=SeqID_96511; Strand=+; Position=137-406
IGLENYFLCRCFIYLFLYFKLLLLHFPPFYSHTQVFSIQCVSDSAANSVNTTANNVTDIQRGCAINGTAGTIAGAASCRCALPTRASRK

SEQ ID NO: 170089 - protein, 152 aa, Heterodera glycines
  Coding regions on vcDNA: vcDNA=SeqID_96512; Strand=-; Position=18-476
VAGLKRHLWRQRQIFFIARRCPSSFHLTSALIDGVPLKLVFHCVYFPFDKCQAVLDKCEAVPYFISKLVDLSEHFISKLFYHFFHCLFPFDDTWQQKVVQQLTGREHIRDGIFGRDERHNFEQQFERKAFGGHCWEKQTVLLFGVISEQLAD

SEQ ID NO: 170090 - protein, 152 aa, Heterodera glycines
  Homolog annotation: Hit_ID=CAE73507.1; Match level="QueryCoverage =95%, HitCoverage=35%, E-value=3e-52, Identity=67%"; Hit description =Hypothetical protein CBG20965 [Caenorhabditis briggsae]
  Gene Ontology: Mol. function=sterol carrier activity; Cellular component=peroxisome; Biological process=steroid biosynthesis
  Coding regions on vcDNA: vcDNA=SeqID_96513; Strand=+; Position=44-499
MVTNAQNRPKVFIVGVGMTKFYKPKSSGKDYPELVREAATEALEDAGLKYDQIEQATASYMYGGSCCGQRALYEMGLTGIPIFNLNNACASGSSGIFLCKQIIESGNVDLMLAVGFEKMNPGSLEATQGMEGDRALPVDKHIQLMADTYGLQ

SEQ ID NO: 170091 - protein, 147 aa, Heterodera glycines
  Coding regions on vcDNA: vcDNA=SeqID_96514; Strand=-; Position=16-459
GNTYSRRTTSLLLLLTILMGVSMQKPTIPQKIIEKARRIKMGKKVVITPYFPKPKSCDGPGTRTEFQTKFLFFNRTLGLLHHFPKFIQDPETRAVGKAVKRILVFEKVRKKYKYRLYCSGSICVSAFHSFDHSLFSIEFTFSSIFNT

SEQ ID NO: 170092 - protein, 117 aa, Heterodera glycines
  Coding regions on vcDNA: vcDNA=SeqID_96515; Strand=-; Position=3-353
YPNLLLGCVECFPNRQQRLAAGRTAEDLYERTVRRLWELEHQHGCELHTVWACEWKERLRRDPALRGRYEHVFVPRPLDPRSDALRGGRTEPFKLHHVCAEGEEILCIDVVSLYPYV

SEQ ID NO: 170093 - protein, 109 aa, Heterodera glycines
  Coding regions on vcDNA: vcDNA=SeqID_96516; Strand=-; Position=353-682
TNYICTNASILAHQTNKVEPHKVFRHHAVRVTVECIVCQKSAPQTYEFSGSGKHAKFVLLQEAMDIATSKIAAINPTRLGLALNFSVFNFEILKSVDEARKLAQKVGPI

SEQ ID NO: 170094 - protein, 247 aa, Heterodera glycines
  Homolog annotation: Hit_ID=BAB14257.1; Match level="QueryCoverage =70%, HitCoverage=43%, E-value=2e-12, Identity=32%"; Hit description =unnamed protein product [Homo sapiens]
  Coding regions on vcDNA: vcDNA=SeqID_96517; Strand=+; Position=114-854
MKHGAKLDAIVTDLVLQPMEEKMETAEAEVRHQTEDIAVASSTCEPELSVHAQFLLTDTLNGLKRTLDDMAQEHKHPIHHLISRCGKAIDTRFFSDLSRLLKNEKEIETDSDNLRHANRLILEHLMGLGRTEVADVFLQESAMSSLEVPDIDNFETLRNIMDSFKRQDYLPTIQWMKANRGEDNDRHDLLFRLQCQHVIRLLETNGKRQALGYVKEMQDEEKEKYKEELKHLMFVVMTHPQKGPHDY

SEQ ID NO: 170095 - protein, 97 aa, Heterodera glycines
  Coding regions on vcDNA: vcDNA=SeqID_96518; Strand=+; Position=191-481
IIHLCSRHYLIFNCDRIQTYNKNRRAKNPKLNTIVISVARINKNGSSKIIRISIIMDGKTIKFIADSGSDINIIDEIAYKCIGSPTLGKSDEEGIFF

SEQ ID NO: 170096 - protein, 79 aa, Heterodera glycines; identical to SEQ ID NO: 164974
  Coding regions on vcDNA: vcDNA=SeqID_96519; Strand=-; Position=91-330

SEQ ID NO: 170097 - protein, 159 aa, Heterodera glycines
  Coding regions on vcDNA: vcDNA=SeqID_96520; Strand=+; Position=2-478
KSGMDVWADIAKADFMDERFSRVITANKAYNLFQNSIAELDERSFRAQAAILNGLLTHHLDFIHGKCVDLRKIGLLLDHFDRLVLRSECLLAQNANISLLRCLVKCSFYCRFADFLLCSSIYQQSFNEFRLLAMAMFCYGLALKWACHKSVKGSDGADS

SEQ ID NO: 170098 - protein, 158 aa, Heterodera glycines
  misc_feature (127)..(127): Xaa can be any naturally occurring amino acid
  Homolog annotation: Hit_ID=CAE64420.1; Match level="QueryCoverage =100%, HitCoverage=33%, E-value=6e-43, Identity=55%"; Hit description= Hypothetical protein CBG09114 [Caenorhabditis briggsae]
  Gene Ontology: Mol. function=DNA dependent ATPase activity
  Coding regions on vcDNA: vcDNA=SeqID_96521; Strand=+; Position=1-473
VIEKQSDPLPISRNTSVAIVLSYDLMVSKAKQLKSNSIYVVVFDECHLLKEQTTQRTKVAFELSKIANRVILLSGTPALSRPSELFTQVRMIDPKIFPSWVKYAVRYCGGKKGRFGFEAKGRCALCXNPDELKTVMDKIMIRRLKKDVLDDLPEKRRE

SEQ ID NO: 170099 - protein, 39 aa, Heterodera glycines
  Coding regions on vcDNA: vcDNA=SeqID_96522; Strand=-; Position=97-216
FSYIIDYLKYIYFYVGFEPELQKCEFRCKLIRQRNSGVY

SEQ ID NO: 170100 - protein, 80 aa, Heterodera glycines; identical to SEQ ID NO: 164083
  Homolog annotation: Hit_ID=NP_508537.1; Match level="QueryCoverage =100%, HitCoverage=3%, E-value=4e-28, Identity=71%"; Hit description =spectrin (spc-1) [Caenorhabditis elegans] gb|AAB53876.1| Spectrin protein 1 [Caenorhabditis elegans] pir|
  Gene Ontology: Mol. function=structural constituent of cytoskeleton; Cellular component=spectrin; Biological process=body morphogenesis (sensu Nematoda)
  Coding regions on vcDNA: vcDNA=SeqID_96523; Strand=-; Position=160-402

SEQ ID NO: 170101 - protein, 41 aa, Heterodera glycines
  Coding regions on vcDNA: vcDNA=SeqID_96524; Strand=+; Position=133-258
ILLSFNAPKCFLFFYKIYFIKFVTLGIFVSVFEWDAENAIE

SEQ ID NO: 170102 - protein, 96 aa, Heterodera glycines
  Coding regions on vcDNA: vcDNA=SeqID_96525; Strand=+; Position=192-479
KRVMANTFPSFAFTYFFVELPTTSSIVWLIHCLFNRGLRLLLLLLFCQCSSSSCSSPVAAPNRRMPTAVFHCAALPVRRKMPQCTAARSLLLERSG

SEQ ID NO: 170103 - protein, 160 aa, Heterodera glycines
  Homolog annotation: Hit_ID=CAF99237.1; Match level="QueryCoverage =100%, HitCoverage=21%, E-value=4e-38, Identity=51%"; Hit description= unnamed protein product [Tetraodon nigroviridis]
  Gene Ontology: Mol. function=GTPase activity; Cellular component =nucleus; Biological process=regulation of G-protein coupled receptor protein signaling pathway
  Coding regions on vcDNA: vcDNA=SeqID_96526; Strand=+; Position=3-482
SGTVCADCGASCPSWASLNHGVLICSDCCFVHRNLGRHFSQVRSLTKGVWHDKQLALLQLLCRNGANNVWEHSLIDSLGGAGRAKKKPVSNDPIIPKKEAFITAKYAQLAFAIRPAKDEFNVDDLNRQLWSCVRTAHVETALRLLALGACPNYADTEKGN

SEQ ID NO: 170104 - protein, 152 aa, Heterodera glycines
  Homolog annotation: Hit_ID=CAE67763.1; Match level="QueryCoverage =100%, HitCoverage=15%, E-value=6e-11, Identity=30%"; Hit description= Hypothetical protein CBG13338 [Caenorhabditis briggsae]
  Coding regions on vcDNA: vcDNA=SeqID_96527; Strand=+; Position=25-480
MFICGGSRLLGNWRPEKALEMARETEDGEENQSQQKTNSGRNQSSSSVWRASIELGPEDSQRLLRFRFFLGFPLQIDPSNCQSSLSLLVVRWEAKMSPRCILPSIESNSMGECNKGVTSEFGSYGGRDRLIMDGWLHGREQRQIFLRMFGTA

SEQ ID NO: 170105 - protein, 58 aa, Heterodera glycines
  Homolog annotation: Hit_ID=AAK54043.1; Match level="QueryCoverage =94%, HitCoverage=15%, E-value=3e-16, Identity=74%"; Hit description =G protein alpha subunit 3 [Strongyloides stercoralis]
  Coding regions on vcDNA: vcDNA=SeqID_96528; Strand=+; Position=15-191
MGICQSIEEKAMDLKTKQIDRELIQEHLDAQKIVKLLLLGAGECGKSTILKQMRLFFK

SEQ ID NO: 170106 - protein, 56 aa, Heterodera glycines
  Coding regions on vcDNA: vcDNA=SeqID_96529; Strand=-; Position=2-169
SIQFLLIISMDVQLNFLQHEPTANWLDYFLERKKLSELLRRNPIGLTLLHFTLIWL

SEQ ID NO: 170107 - protein, 155 aa, Heterodera glycines
  Coding regions on vcDNA: vcDNA=SeqID_96530; Strand=+; Position=32-496
KKIMEQLDSTLNAAKNETERLAEQLKKSAEQAQKEVRERTLHQDPYLRLVYQLQTAHLIALGIEVLTLYLGWRDVNFVWLLLPLLFCAGAIWIVSQRWYHQMDGRSDFNKVLSADKMPVRAKAASCLVGGFVLSLLAQWTAPTMGSTSIGLLFSL

SEQ ID NO: 170108 - protein, 146 aa, Heterodera glycines; identical to SEQ ID NO: 162568
  Coding regions on vcDNA: vcDNA=SeqID_96531; Strand=+; Position=2-442

SEQ ID NO: 170109 - protein, 152 aa, Heterodera glycines
  Coding regions on vcDNA: vcDNA=SeqID_96532; Strand=+; Position=3-458
IDETIKFPVFHCCNGSHQESFHQSFGQKAPNEPLKKRDSSVELLNDNNSFFKIRDSSAEFHNDVKLLGVGGQSHQGPFHEFIDDDFLFEKAEQHPPIVVANPSAPNGPFKIRDSSAEFHNDVNLLGVGGQKDVFRKLKDVFGFSYFRFKQKP

SEQ ID NO: 170110 - protein, 118 aa, Heterodera glycines
  Homolog annotation: Hit_ID=CAE69464.1; Match level="QueryCoverage =86%, HitCoverage=32%, E-value=1e-19, Identity=53%"; Hit description =Hypothetical protein CBG15660 [Caenorhabditis briggsae]
  Gene Ontology: Mol. function=3-phosphoinositide-dependent protein kinase activity; Cellular component=plasma membrane; Biological process=insulin receptor signaling pathway
  Coding regions on vcDNA: vcDNA=SeqID_96533; Strand=+; Position=188-541
MSDIAGASSSAFSADASSTKKKGDFLFLAELGEGSYSTVYLASERQTSRKFAVKMCLKKKIIKEKKVQQIFRERDILRLLSTPANACPFVVHLFCTFQDDESLFFVLSYAPKKDLMAR

SEQ ID NO: 170111 - protein, 242 aa, Heterodera glycines
  Coding regions on vcDNA: vcDNA=SeqID_96534; Strand=-; Position=114-842
ALISAEEILDTKISFLESVRKIKKTHEEINRAFDMEKFDIIQRTMRMYFESEDSSDVFEGFLNVVKYVKSLTTEQLDISLVKLALLAFYEFQKLGIAQGQQIPFDLHIDKTLLLDALVPCFRLKTKYIEAISSVFHLKDREMVEVAIAQIKTLLENEVPKAVFWMDHLNLRDHFPFNTIVCKLILENQTALIYPFVGESQFRRNKLIHYLDNLLGLVLRNRRAEDEYEREIMKNQKQLEKVG

SEQ ID NO: 170112 - protein, 97 aa, Heterodera glycines
  misc_feature (51)..(51): Xaa can be any naturally occurring amino acid
  Homolog annotation: Hit_ID=NP_908377.1; Match level="QueryCoverage =65%, HitCoverage=2%, E-value=7e-14, Identity=53%"; Hit description =AtATM like protein [Oryza sativa (japonica cultivar-group)]
  Gene Ontology: Mol. function=protein serine/threonine kinase activity; Cellular component=intracellular; Biological process=DNA damage response, signal transduction resulting in induction of apoptosis
  Coding regions on vcDNA: vcDNA=SeqID_96535; Strand=-; Position=2-366
KFCDKILIQKITLLLVCQFQIVPFRLTRNMVDGFGATGVEGTFRKSCEKAXKVMRAESRMLRTVLHAFAHDPLLEWTTTEARNQQYRQVRLVARAVY

SEQ ID NO: 170113 - protein, 173 aa, Heterodera glycines
  Homolog annotation: Hit_ID=NP_493617.2; Match level="QueryCoverage =64%, HitCoverage=38%, E-value=1e-10, Identity=37%"; Hit description =i-90 protein (34.4 kD) (1P608) [Caenorhabditis elegans] emb|CAB04261.2| Hypothetical protein F33H2.6 [Cae
  Coding regions on vcDNA: vcDNA=SeqID_96536; Strand=+; Position=30-548
MFRRFISSAPNVAKVFGGVGLSTVVAAAIPDVELKKKPDWYQETVHRLEKTLKKLSTYAYIENSDILEDAKDILMRCENVNNCDISWRLGRALSEKGDLFSVVDSENRIEFFAKAIPHFQKAFTLEPKNGSAGAHKWYAITLKRLRLITSQHPYVKNANKEVIEHLEKAHQID

SEQ ID NO: 170114 - protein, 149 aa, Heterodera glycines
  Homolog annotation: Hit_ID=NP_510362.1; Match level="QueryCoverage =99%, HitCoverage=40%, E-value=2e-50, Identity=67%"; Hit description =isocitrate dehydrogenase (41.6 kD) (XO790) [Caenorhabditis elegans] emb|CAB02822.1| Hypothetical protein
  Gene Ontology: Mol. function=isocitrate dehydrogenase (NAD+) activity; Cellular component=mitochondrial matrix; Biological process=TCA intermediate metabolism
  Coding regions on vcDNA: vcDNA=SeqID_96537; Strand=+; Position=138-584
MFSLQAIAVPEIAKKLKCTLIPGDGVGPDQSYAVQDIVKATGIPIEFEEVFLSEVYYSRSASIEDVVDSIARNNCVALKGAIQSSLDDKTDGLNTQLRKRLDLFANVVHIKALEGIRTRHNKMLDFVIIREQTEGEYSRMEHELVPGVI

SEQ ID NO: 170115 - protein, 155 aa, Heterodera glycines
  Homolog annotation: Hit_ID=NP_495406.1; Match level="QueryCoverage =77%, HitCoverage=54%, E-value=1e-20, Identity=42%"; Hit description =putative protein, with a coiled coil-4 domain, of ancient origin (2H170) [Caenorhabditis elegans] gb|AAA6
  Coding regions on vcDNA: vcDNA=SeqID_96538; Strand=+; Position=3-467
MHIINNSIWLKFLITAFLFKIACSKFGSSENKGFFFYFGYGSNLLEERIHVQVKGATFVAIGALKGYRLAFVDFEEPNRWHSAAATIEQKQGSLVWGCIWKVPNSFADELDKQETKYKRIDVTVFPRPSTNERFNLNMRLFSNFVIKCRTYQYER

SEQ ID NO: 170116 - protein, 162 aa, Heterodera glycines
  Homolog annotation: Hit_ID=NP_506019.2; Match level="QueryCoverage =82%, HitCoverage=23%, E-value=5e-28, Identity=45%"; Hit description =aspartyl(D) tRNA Synthetase (drs-2C) [Caenorhabditis elegans] emb|CAB04081.2| Hypothetical protein F10C2.
  Gene Ontology: Mol. function=diacylglycerol O-acyltransferase activity; Biological process=regulation of nurse cell apoptosis
  Coding regions on vcDNA: vcDNA=SeqID_96539; Strand=+; Position=81-566
MFFTICSFSRFPFSSHLLFFAPFSSRAFVNSFSLRTHNCGELRLSDVGSRVKLFGWMAAKRMNKFVLLRDSYGSVQTVLPKALFSSLKNTNFESALCLEGVVADRGKERNDKMPTGDIEVVVDGLEVLNPSDAPLPVDESSNEYTRITHRYLDLRSEKMQRA

SEQ ID NO: 170117 - protein, 220 aa, Heterodera glycines
  Homolog annotation: Hit_ID=CAB62924.1; Match level="QueryCoverage =88%, HitCoverage=16%, E-value=3e-19, Identity=30%"; Hit description =OTTHUMP00000028562 [Homo sapiens]
  Coding regions on vcDNA: vcDNA=SeqID_96540; Strand=+; Position=2-661
PNGPCAAHLLNLAVQEALKRDESISSLLAKTRHIVGRFKHSNTAFSELKKIQKLLDAPSHTLLQMVCVRWNSALTMCERLIEQRAAITQYAVDNNEFELLLKNDEWEQIEELVGVLKCAEEATKRFTAEPISFVIPQARALHDELYEMKIVNRTVETIRTTLYFAVERRFFGLANLKEYALATFFDVRFKDKVLTENSATFRARVTVWIKNELKEWENDN

SEQ ID NO: 170118 - protein, 116 aa, Heterodera glycines; identical to SEQ ID NO: 162560
  Coding regions on vcDNA: vcDNA=SeqID_96541; Strand=+; Position=29-379

SEQ ID NO: 170119 - protein, 125 aa, Heterodera glycines
  Homolog annotation: Hit_ID=CAE64816.1; Match level="QueryCoverage =65%, HitCoverage=9%, E-value=3e-20, Identity=52%"; Hit description =Hypothetical protein CBG09610 [Caenorhabditis briggsae]
  Coding regions on vcDNA: vcDNA=SeqID_96542; Strand=+; Position=44-418
MMEMTILGNRISITADGAKVSPFGSKMDMGDYYVENNKLRKTRGLGWVMAALFVVADMAGGGIVALPTAVVRCQFFSGLLILLCMAIISTFSAVMLGQCWEILLRRFPVYRTHCRKPYAEIGLKA

SEQ ID NO: 170120 - protein, 158 aa, Heterodera glycines
  Coding regions on vcDNA: vcDNA=SeqID_96543; Strand=+; Position=1-474
AKGLQPWRSTTTTTTTTTTVTTTPIPQRPPAPVVTPPAAPPRAVLPDLPPQTVPTNARLQNFGPSANELQMNRRVDSSTDNDGQSASTLRQANKGGTRRGGTKRQDKANRALHMRLARLRQSQLAAKREFERNMQMKANNAAQSPASNCFDRAPWCSG

SEQ ID NO: 170121 - protein, 141 aa, Heterodera glycines
  Coding regions on vcDNA: vcDNA=SeqID_96544; Strand=+; Position=1-423
VSLFLLSINAQRYGSHSYGSGTYGTNYWSSSYGNSRTQPSYGYGGQQSRYGTHEQNGGENGQFERQNAWRGGGGQWGQNQQNWGQPQQQQGATAAVEGGWGRRQQQQFPSPAPPKTQNNWDNSDNFAPSTAQNRGKLRVDL

SEQ ID NO: 170122 - protein, 204 aa, Heterodera glycines
  Coding regions on vcDNA: vcDNA=SeqID_96545; Strand=-; Position=1-612
KFCSAFSSLFRLFLHLYTSSRLGDSTRTYAKQQLYWPPLQSKFLFPHRSIESVPPVAVLRQRLLRLVVQFQFYFRAVPLRVVPYLVFGSCCPRQRRAGICAHGRLQWGPGWPRVVKNCNIGQSTADGIAAAVLPPARRRSLPFGWRSVPHLRERRPRRSQEAGGLHVQSGDRGVATVVHTKGGTPKSAQLSHQPTRNESLWWPT

SEQ ID NO: 170123 - protein, 178 aa, Heterodera glycines
  Coding regions on vcDNA: vcDNA=SeqID_96546; Strand=+; Position=74-607
MLNHIYNINTTTAATAQQPRKRGTTGTTKHGTMPAPTTTKASGSSERGGGTQFHQFTNGRQVTTGQRRKGATGNEARDRTLASQPPLLPPLTSVYDFKDVVGIGSGAFANVFRARELITAAPAERYRHVALKRINLSAIEKENQLMYESVLNEVDIFKSLSHTNIVKCFYSFTEISPH

SEQ ID NO: 170124 - protein, 175 aa, Heterodera glycines
  Coding regions on vcDNA: vcDNA=SeqID_96547; Strand=+; Position=3-527
TKANRRCCRGRICCVSPAKSRNGTSDASPDGSIGACPPVSRRTSTGAASAVWTYGKHRGTLRSIFLNIPLHQCPLCEYGAAEARLVQRHMRNNHTLKECEGMEPIANVEKHRAEFSELHNQCFPGRPKRLSNITIADESRRAKCRGCAQTISKKRRLLHLLEKHLKKPIYKCKYC

SEQ ID NO: 170125 - protein, 117 aa, Heterodera glycines; identical to SEQ ID NO: 162548
  Coding regions on vcDNA: vcDNA=SeqID_96548; Strand=+; Position=91-444

SEQ ID NO: 170126 - protein, 235 aa, Heterodera glycines
  misc_feature (61)..(61): Xaa can be any naturally occurring amino acid
  Homolog annotation: Hit_ID=NP_741119.1; Match level="QueryCoverage =91%, HitCoverage=97%, E-value=3e-53, Identity=45%"; Hit description =putative membrane protein of eukaryotic origin (25.0 kD) (3F971) [Caenorhabditis elegans] gb|AAK93840.2|
  Gene Ontology: Mol. function=purine nucleotide binding; Cellular component=cytoplasm
  Coding regions on vcDNA: vcDNA=SeqID_96549; Strand=+; Position=1-709
HHFSVLFVLSFFSFPLFFAVFVSSAAEQNANLQKQQQLFTIEGKTVVNAELQRIKPNWKAXKRIFLDYGKFVGFIRQDGSFIVPDVPSGSYILEVASGDFQFESVRVDITNSGKIRARRLNLVQPNVVSTLPYPVKLTARHPMRYFRVREEWRVTDVLMNPMMLMMGAAFILVVLMPKLAAQDPNVQKEMQNMQLPKVDMPDMADMLANIWSSGSNKKGSRKQISSGQSTKRVTR

SEQ ID NO: 170127 - protein, 112 aa, Heterodera glycines
  Homolog annotation: Hit_ID=NP_491624.1; Match level="QueryCoverage =97%, HitCoverage=38%, E-value=2e-25, Identity=49%"; Hit description =ribophorin II (31.1 kD) (1G118) [Caenorhabditis elegans] gb|AAB42275.1| Hypothetical protein M01A10.3 [Ca
  Gene Ontology: Biological process=locomotory behavior
  Coding regions on vcDNA: vcDNA=SeqID_96550; Strand=+; Position=24-362
MSPKSSHVNYDLLPEISHTFRSPEPRPSVLVSDMFSVLCASPLIILFLLWLRIGINFGKFKFSLSALGFHLGLCVFFGLYVFFWLELNMFQTLKWLAVIGVPTLFLGSRLSF

SEQ ID NO: 170128 - protein, 184 aa, Heterodera glycines
  misc_feature (63)..(63): Xaa can be any naturally occurring amino acid
  Homolog annotation: Hit_ID=CAE65012.1; Match level="QueryCoverage =97%, HitCoverage=94%, E-value=1e-39, Identity=47%"; Hit description =Hypothetical protein CBG09850 [Caenorhabditis briggsae]
  Coding regions on vcDNA: vcDNA=SeqID_96551; Strand=+; Position=24-576
MTLRNDTPMPPDEELRVPHEISLSSPWLRAVAVYMGIACEKEAKEFMLLRSERDNDPRKALPXGRAVTACAINFLRKMRRECGDEIRDYANCFHRESGRMHLHQCRRAQFPMDICADEKLGVRRPMVGYFNKLHVHESAVPPPDPLERQKLYRDYKAEGGKLLEELPEDWKTDPKSVQKYRKHF

SEQ ID NO: 170129 - protein, 123 aa, Heterodera glycines
  Homolog annotation: Hit_ID=CAE74899.1; Match level="QueryCoverage =87%, HitCoverage=96%, E-value=2e-17, Identity=37%"; Hit description =Hypothetical protein CBG22765 [Caenorhabditis briggsae]
  Coding regions on vcDNA: vcDNA=SeqID_96552; Strand=+; Position=88-459
MSVPETHSPTVEQLPKLPTELQSEVAQRAGLKHVTTLEKNVLPTKEDLEEERKHESFKKGIQNFDALKLRHVETEDKCMLPSSNDIAVEKTPQLAAEFDQSGLKHVETTVKTNIEVIDKAEQN

SEQ ID NO: 170130 - protein, 159 aa, Heterodera glycines
  Homolog annotation: Hit_ID=NP_503119.1; Match level="QueryCoverage =82%, HitCoverage=25%, E-value=9e-37, Identity=56%"; Hit description =glucocerebrosidase (4S421) [Caenorhabditis elegans] emb|CAB02924.1| Hypothetical protein F11E6.1a [Caenor
  Gene Ontology: Cellular component=extracellular space
  Coding regions on vcDNA: vcDNA=SeqID_96553; Strand=+; Position=1-477
GTPGGEQTIDGVAVHWYSPGDYDKLTKVHNLRPNKFIFASEACTGYEVFEHKVLLGDWSRGRAYARDILNDLRNWVVGWTDWNMCLDLEGGPNLARNFVDSPIIVNASAGEFYKQPMFYAMAHFSRFVPRDSSVIGSSLFVANGGVNKLGEKKVDKSVV

SEQ ID NO: 170131 - protein, 75 aa, Heterodera glycines
  Homolog annotation: Hit_ID=NP_508475.1; Match level="QueryCoverage =100%, HitCoverage=10%, E-value=8e-13, Identity=44%"; Hit description= putative protein, with 2 coiled coil-4 domains, of fungal and metazoan origin (XD302) [Caenorhabditis el
  Coding regions on vcDNA: vcDNA=SeqID_96554; Strand=+; Position=3-230
LDLNRYDPYELLARCRHFVQQRDLLNAVRVANLIRGKSARIFSDWLKDAKFHLEVRLLVELLLAHSQASGIRTTY

SEQ ID NO: 170132 - protein, 163 aa, Heterodera glycines
  Homolog annotation: Hit_ID=NP_741269.1; Match level="QueryCoverage =70%, HitCoverage=20%, E-value=2e-12, Identity=38%"; Hit description =coronin (67.1 kD) (cor-1) [Caenorhabditis elegans] emb|CAA83461.1| Hypothetical protein R01H10.3a [Caenor
  Coding regions on vcDNA: vcDNA=SeqID_96555; Strand=+; Position=6-497
MDVSVGEESPHQQRFLEECLNLSQKFLKEMSKDEEQQQNVINGEANDGKSDVAKELLICHSSSPTASPQPSGCFLTSANVVAELDRIRREQNRSGAGEADGQSTAATTPNASRRPSNSSAAAVSGSVEDELAKIKVVLRQHERRIRLLEDQLADANMANAYGI

SEQ ID NO: 170133 - protein, 128 aa, Heterodera glycines
  Coding regions on vcDNA: vcDNA=SeqID_96556; Strand=+; Position=1-387
ACIYTATAPNLTCHRQDQSLMEILRYNMEYRQQIEGWFENQSADPNFFGISYARFCFSKIPVPNYSFFPNNLCIFKSDPSFLTQLNPAHPRSSNRPLQSSGIRGFFDLLRGKHFGGSQSEWLQRVQCC

SEQ ID NO: 170134 - protein, 151 aa, Heterodera glycines
  Coding regions on vcDNA: vcDNA=SeqID_96557; Strand=+; Position=233-685
SMNLRKKPKVEPIEDEIPENEQQINISTRSHNSSYNSDRVNENDLVKSLSQCLLANVSKRGFVRDADIGEMFSDRRERELRANVLKKSEKLLMDVLGYRLDRDEEGKRFYLSTNLCKGIAMAMEISDDTHRGLNEFADEDAFEEESTQTEQ

SEQ ID NO: 170135 - protein, 117 aa, Heterodera glycines
  Homolog annotation: Hit_ID=NP_509294.1; Match level="QueryCoverage =98%, HitCoverage=26%, E-value=6e-29, Identity=52%"; Hit description =DeHydrogenase, Short chain (48.0 kD) (dhs-29) [Caenorhabditis elegans] gb|AAK68350.1| Dehydrogenases, sho
  Gene Ontology: Mol. function=catalytic activity; Cellular component =cytoplasm; Biological process=estrogen metabolism
  Coding regions on vcDNA: vcDNA=SeqID_96558; Strand=+; Position=37-614
LKGRVDIVLCSAALLYVVPILELNDADIQRSMDVNAMGTINTIRVFLPEMEARGKGHIVAMGSIASHFGEVFQMAYSPTKFAVRGAMECLRVELKERGLEDILCTTIYPFYVRTPMV

SEQ ID NO: 170136 - protein, 153 aa, Heterodera glycines
  Coding regions on vcDNA: vcDNA=SeqID_96559; Strand=+; Position=92-550
MKPQEFSGADNEQPSPSRHSIIGVKRKFSSIDYASSNSPVKVLPSFTSTFLPDLSNAQVLKPKPTNVDRLPLSNEEFITPTQPKKQQSRPNSPANGVSKLILPRSRVASIRRESDCNPEKGFGEAEAAHEKMVKSAQQVAMGFEDFCLDDKAF

SEQ ID NO: 170137 - protein, 132 aa, Heterodera glycines
  Homolog annotation: Hit_ID=NP_495449.1; Match level="QueryCoverage =49%, HitCoverage=16%, E-value=1e-25, Identity=81%"; Hit description =cystathionine gamma-lyase (43.1 kD) (2H346) [Caenorhabditis elegans] gb|AAB93432.1| Hypothetical protein
  Gene Ontology: Biological process=sulfur amino acid metabolism
  Coding regions on vcDNA: vcDNA=SeqID_96560; Strand=+; Position=100-495
MLVDSLRPATLSSSKKRSAHSIDDTDQFIDHSPPHKKQLMDEENDQILTQNTPNDSLDRRRPIAFATKAIHAGNRPEQWDMNQVVPPISLSTTYKQSRPGEPKGHDYSRAGNPTRDVLQENLASLEGARFAR

SEQ ID NO: 170138 - protein, 201 aa, Heterodera glycines
  Homolog annotation: Hit_ID=NP_501970.1; Match level="QueryCoverage =96%, HitCoverage=5%, E-value=2e-34, Identity=38%"; Hit description =EGF motif related, Lin-12 and Glp-1 X-hybridizing, abnormal EPIthelia EPI-1 (407.8 kD) (epi-1) [Caenorhabd
  Gene Ontology: Mol. function=extracellular matrix structural constituent; Cellular component=basal lamina; Biological process =cell-cell signaling
  Coding regions on vcDNA: vcDNA=SeqID_96561; Strand=+; Position=16-618
MNIQSSRSVLDDQWHTLLVEREAGAAVLYLDGRLEAQNRTNLGTIELLQLQSPLYIGGLPPELVPLAARLLPGVKPEFGGCLREFSLNDLALEEPVAEKDIAQCSQFIEQGIFFGKDGGYAILSPQFVVGLSFSFELELKPRTKTAVLLSVGVLEFLSLQLLNGTGKFREGQRWRHGIRCSTSQSVPTSWCDGPWDPDPNL

SEQ ID NO: 170139 - protein, 125 aa, Heterodera glycines; identical to SEQ ID NO: 162536
  misc_feature (71)..(71): Xaa can be any naturally occurring amino acid
  Homolog annotation: Hit_ID=AAP30767.1; Match level="QueryCoverage =100%, HitCoverage=100%, E-value=1e-31, Identity=59%"; Hit description=putative gland protein G21E12 [Heterodera glycines]
  Coding regions on vcDNA: vcDNA=SeqID_96562; Strand=+; Position=40-417

SEQ ID NO: 170140 - protein, 146 aa, Heterodera glycines
  Coding regions on vcDNA: vcDNA=SeqID_96563; Strand=+; Position=3-443
LLFHFIFAFKNVSLLLQLNLRFMSSVRRMLFLLGRKCCCSTVPCSATANGFGSIQRRRLWTSMARLSSSGPFICMMPLKKRQMFISDVYKHDHFLHFDHLHIDNIHCARKLVVHLRPSERTLLLQALTELNAEAKTDGNGHSGGPP

SEQ ID NO: 170141 - protein, 159 aa, Heterodera glycines
  Homolog annotation: Hit_ID=CAE64788.1; Match level="QueryCoverage =82%, HitCoverage=84%, E-value=1e-24, Identity=46%"; Hit description =Hypothetical protein CBG09581 [Caenorhabditis briggsae]
  Gene Ontology: Mol. function=thiol-disulfide exchange intermediate activity; Cellular component=mitochondrion
  Coding regions on vcDNA: vcDNA=SeqID_96564; Strand=+; Position=14-490
MIFRQFLRRFLVANHRFVPLESFWVGRLNSVLHSTVCGVGPSNFSTGFANHLVQHRFFSSQSDGLNVFELGSENDFDDRVLQAQQPVMVQFYADWCGPCQNLAPRIEAKVNGQNGEVLLARINVDSSLGFLTAQFDVTSVPTVVCFHNGEVIHRFEGDV

SEQ ID NO: 170142 - protein, 45 aa, Heterodera glycines
  Coding regions on vcDNA: vcDNA=SeqID_96565; Strand=-; Position=12-149
EWNRFSGFRHPFKKKSRPSVRENTFFKFFFVVSFLKKFSRQTKNN

SEQ ID NO: 170143 - protein, 147 aa, Heterodera glycines
  Coding regions on vcDNA: vcDNA=SeqID_96566; Strand=+; Position=3-446
DARFQLREQLIMYCINDVAILRESVLRFRKLIGEHTQGLDPFLVSSTAAGLALSTLRRCFLPFNRLVHSPEGGYLRGRRASAESRRYIRFFELENPGAQVQCADWSVGEANIEDTGYRVDGLWRREPPLRPLAIEWMGCYYHGVLSS

SEQ ID NO: 170144 - protein, 26 aa, Heterodera glycines
  Coding regions on vcDNA: vcDNA=SeqID_96567; Strand=-; Position=93-173
NKLNQKIFCRHPPPFLMYVSVKKIQV

SEQ ID NO: 170145 - protein, 143 aa, Heterodera glycines
  Homolog annotation: Hit_ID=AAV73809.1; Match level="QueryCoverage =93%, HitCoverage=81%, E-value=3e-22, Identity=45%"; Hit description =superoxide dismutase [Gryllotalpa orientalis]
  Gene Ontology: Mol. function=copper, zinc superoxide dismutase activity; Cellular component=cytoplasm; Biological process =neurogenesis
  Coding regions on vcDNA: vcDNA=SeqID_96568; Strand=+; Position=55-483
MDVPQAPDKKAICVLANNRADSKEGVGTVMFQQKDGEDVRVTVVIGGLGPDHQHALTIYQFGDLTVSSGNFHSTGKHFSHAGQKHSPPEAVSRHVGDLGNITADSKGVAKRNWSDKVISLFGQNNIIGRSVAVHARKDDFGEG

SEQ ID NO: 170146 - protein, 63 aa, Heterodera glycines; identical to SEQ ID NO: 164842
  Coding regions on vcDNA: vcDNA=SeqID_96569; Strand=+; Position=3-194

SEQ ID NO: 170147 - protein, 79 aa, Heterodera glycines
  Coding regions on vcDNA: vcDNA=SeqID_96570; Strand=+; Position=29-268
IFKISRFPVPKKNRGPGPGFSGPGKSRSRFCPKFPVPLHSSKNLRILSLLMIQLQFANLLNVFAIVNVRALYCAFGSHL

SEQ ID NO: 170148 - protein, 97 aa, Heterodera glycines; identical to SEQ ID NO: 164839
  Homolog annotation: Hit_ID=CAE56395.1; Match level="QueryCoverage =98%, HitCoverage=12%, E-value=8e-13, Identity=40%"; Hit description =Hypothetical protein CBG24082 [Caenorhabditis briggsae]
  Coding regions on vcDNA: vcDNA=SeqID_96571; Strand=+; Position=3-296

SEQ ID NO: 170149 - protein, 197 aa, Heterodera glycines
  Homolog annotation: Hit_ID=NP_509544.1; Match level="QueryCoverage =71%, HitCoverage=59%, E-value=6e-44, Identity=63%"; Hit description =calmodulin (XJ770) [Caenorhabditis elegans] gb|AAA68320.1| Hypothetical protein B0563.7 [Caenorhabditis e
  Gene Ontology: Mol. function=calcium ion binding; Cellular component =spindle pole body; Biological process=cell organization and biogenesis
  Coding regions on vcDNA: vcDNA=SeqID_96572; Strand=+; Position=100-803
MSSGDEATTPALTSGGGASSTRTAGGGSAFQRWGGNRRGSHLVGWDSARPQSAARQQQQMLERMYSKSELHEYQQLFKMFDTDGSGAIGCEELKGAMLSIGLQADDAEIERLIKEVDEDGNGEIDFPEFCQCMKRSQQSGGIKGRLSNEEVSRQCFEVFDQDSNGLITENEFIYVAKEVGGFSQELAEFVFRELLGD

SEQ ID NO: 170150 - protein, 325 aa, Heterodera glycines
  Homolog annotation: Hit_ID=NP_500617.1; Match level="QueryCoverage =99%, HitCoverage=31%, E-value=1e-108, Identity=62%"; Hit description= dehydrogenase, E1 component and Transketolase, central region (115.7 kD) (4F462) [Caenorhabditis elegans
  Gene Ontology: Mol. function=oxoglutarate dehydrogenase (lipoamide) activity; Cellular component=mitochondrial matrix; Biological process=embryogenesis and morphogenesis
  Coding regions on vcDNA: vcDNA=SeqID_96573; Strand=+; Position=25-999
MFRIVAKRSLSTTRQWLQQPTHRPPSSALSAEPFMNATSGVYIEQMYESWQLDRGSVHRSWDAFFTNVNAGAAPGQAFQAPPSVPSLSTVPHATVVPRDMREVQPQTAGQVIPADELTRAINDHLKIQVLIRSFQTRGHNIADLDPLGINSADLDDTIPRELELDFYGFTEQDMDREFLLPPTTFIGGERATLSLREIYKRLKKIYCHHIGVEYMHLTNDEQQDWIRNHFEAPEVTELPPEQKKVLFKRLIRSTKFEDFLAKKWPRKTRFGLEGCEVLVPAIEQVIDCSHELGVNSIVLGMPHRGRLNVFANVCQQPVSTVLGLF

SEQ ID NO: 170151 - protein, 115 aa, Heterodera glycines; identical to SEQ ID NO: 162526
  Homolog annotation: Hit_ID=EAA40667.1; Match level="QueryCoverage =68%, HitCoverage=18%, E-value=2e-12, Identity=41%"; Hit description =GLP_456_61251_62507 [Giardia lamblia ATCC 50803]
  Gene Ontology: Mol. function=protein kinase activity; Cellular component=cytosol; Biological process=MAPKKK cascade (cell wall biogenesis)
  Coding regions on vcDNA: vcDNA=SeqID_96574; Strand=+; Position=3-350

SEQ ID NO: 170152 - protein, 77 aa, Heterodera glycines; identical to SEQ ID NO: 164830
  Coding regions on vcDNA: vcDNA=SeqID_96575; Strand=+; Position=1-234

SEQ ID NO: 170153 - protein, 122 aa, Heterodera glycines
  Homolog annotation: Hit_ID=NP_492811.1; Match level="QueryCoverage =99%, HitCoverage=33%, E-value=1e-53, Identity=80%"; Hit description =casein kinase ii (42.3 kD) (1L311) [Caenorhabditis elegans] gb|AAC16993.1| Protein kinase protein 3 [Caen
  Gene Ontology: Mol. function=protein kinase CK2 intrinsic catalyst activity; Cellular component=protein kinase CK2 complex; Biological process=signal transduction
  Coding regions on vcDNA: vcDNA=SeqID_96576; Strand=+; Position=123-488
MPTPSRARVYADVNVNKPREYWDYECHQIRWGNIDDYQLVRKLGRGKYSEVFEGVMVPSEQKVVIKILKPVKKKKIKREIKILENLRGGTNVIGLLDVVKDPVSRTPALVFEYVNNTDFKQL

SEQ ID NO: 170154 - protein, 171 aa, Heterodera glycines
  Homolog annotation: Hit_ID=EAA49399.1; Match level="QueryCoverage =90%, HitCoverage=22%, E-value=1e-17, Identity=39%"; Hit description =hypothetical protein MG01057.4 [Magnaporthe grisea 70-15] ref|XP _368187.1| hypothetical protein MG01057.4
  Gene Ontology: Mol. function=general transcriptional repressor activity; Cellular component=nucleus; Biological process=regulation of protein activity, epigenetic
  Coding regions on vcDNA: vcDNA=SeqID_96577; Strand=+; Position=81-593
MTKNQAAEQARLQAEQQLKAQQEAAKRQAEERAQQLKAQQQQQQQQSVQVQQQKQQQPPISPSATAQQQKAAPAPAAQPPAKAPQQPQAPKAAVAPAQQQQQPKAAAPPPPKAAAAPQQPKATAVAAPPKPTAPPAVAPQKRAPSPVVREVQLPEAPTQPILRHAEYTPKL

SEQ ID NO: 170155 - protein, 125 aa, Heterodera glycines; identical to SEQ ID NO: 162520
  Coding regions on vcDNA: vcDNA=SeqID_96578; Strand=+; Position=88-465

SEQ ID NO: 170156 - protein, 159 aa, Heterodera glycines
  misc_feature (108)..(108): Xaa can be any naturally occurring amino acid
  Coding regions on vcDNA: vcDNA=SeqID_96579; Strand=+; Position=1-477
NQSSPLLMPRSTRATMSCSSRATRSGSRFCGSGGPAPRLYIWSGGVLPTRLTSRLNSLFSSTSITTFPSSISSAAHPIARPNCCFTSWTSESGSSIGSGSDSVGGCVXTSVGAGPSTSGTKSCSLREEVDGTLRFRGGTTSPTALRSRLRVILSVAPKS

SEQ ID NO: 170157 - protein, 120 aa, Heterodera glycines
  Homolog annotation: Hit_ID=CAF94810.1; Match level="QueryCoverage =71%, HitCoverage=44%, E-value=5e-21, Identity=62%"; Hit description =unnamed protein product [Tetraodon nigroviridis]
  Gene Ontology: Mol. function=ATP-binding cassette (ABC) transporter activity; Cellular component=integral to plasma membrane; Biological process=transport
  Coding regions on vcDNA: vcDNA=SeqID_96580; Strand=-; Position=395-830
MHKVYGYVGIRGTVAYVPQQVQILNRTLRENIIFPVTEEEKPDEQHYAKVVKACALTADFSVLPNGDQTEIGEKGINLSGGKKARVRVMERKEYGRTKKLGIVKKSAKDISTVKDFSTEK

SEQ ID NO: 170158 - protein, 160 aa, Heterodera glycines
  Homolog annotation: Hit_ID=CAE56731.1; Match level="QueryCoverage =99%, HitCoverage=30%, E-value=8e-54, Identity=62%"; Hit description =Hypothetical protein CBG24518 [Caenorhabditis briggsae]
  Gene Ontology: Mol. function=polypeptide N -acetylgalactosaminyltransferase activity; Cellular component =integral to membrane; Biological process=O-linked glycosylation
  Coding regions on vcDNA: vcDNA=SeqID_96581; Strand=+; Position=2-481
SIIITFHNEARSTLLRTIWSIFIRTPSHLLKEIILVDDYSFDATIGRDLFGIDKMRIIRNRKREGLIRSRVHGAIIASAPVLTFLDSHCECNVGWLEPVLQRLVENDKAVVAPVIDVINMDNFNYVSASSDLRGGFGWNLVFRWEALGREEKLFRRKKPE

SEQ ID NO: 170159 - protein, 123 aa, Heterodera glycines
  Coding regions on vcDNA: vcDNA=SeqID_96582; Strand=+; Position=1-369
YIYYIIRANTVYKQKTNQYKKCIYICTFSIFFGSWIHSKLCCFNDSSYTNFVFRICVHLQTCSKKQTSKKMKRNGNSICSETKSPLLELTPKNALTFRGIVWAGPFVFRDVTPPKAISLNSEV

SEQ ID NO: 170160 - protein, 169 aa, Heterodera glycines; identical to SEQ ID NO: 164344
  misc_feature (46)..(46): Xaa can be any naturally occurring amino acid
  misc_feature (147)..(147): Xaa can be any naturally occurring amino acid
  Homolog annotation: Hit_ID=NP_728531.1; Match level="QueryCoverage =97%, HitCoverage=12%, E-value=8e-53, Identity=58%"; Hit description =CG17090-PB, isoform B [Drosophila melanogaster] ref|NP_612038.2| CG17090-PA, isoform A [Drosophila melano
  Gene Ontology: Mol. function=ATP binding; Cellular component=nuclear speck; Biological process=protein amino acid phosphorylation
  Coding regions on vcDNA: vcDNA=SeqID_96583; Strand=+; Position=148-654

SEQ ID NO: 170161 - protein, 173 aa, Heterodera glycines
  Coding regions on vcDNA: vcDNA=SeqID_96584; Strand=+; Position=2-520
KTPVWWSSERHIGFNHLVQAVDVGDFVELYDGGGPIRRLPPGPALPKTRILDGSNGTRSCLKVKVNFMPLDFLLFPVSAKEKNLRMAMSAELGPIPIANENSFKLHCFYRGVATLFFAKDSKEEMIAEVYNTPWLIKSDGASLAESDFSTIVHTFAFCQSQDVHRQGLVVDAS

SEQ ID NO: 170162 - protein, 143 aa, Heterodera glycines
  misc_feature (24)..(24): Xaa can be any naturally occurring amino acid
  misc_feature (74)..(74): Xaa can be any naturally occurring amino acid
  misc_feature (113)..(113): Xaa can be any naturally occurring amino acid
  Homolog annotation: Hit_ID=AAS66225.1; Match level="QueryCoverage =88%, HitCoverage=57%, E-value=2e-23, Identity=47%"; Hit description =LRRG00134 [Rattus norvegicus]
  Coding regions on vcDNA: vcDNA=SeqID_96585; Strand=+; Position=84-514
SQFFSRSYESNLPTSLTYIILSTXRLFTLETCCGYRYDQAGDSNSFPRIFKGRVFFTRHHRNRGALRAQHPYLXAEPLPGTHTLNQKRELWLGLHTTSASSFALPRKTALANXISLAWRGNVNPLPFRQPDGPTAQAQKSRHP

SEQ ID NO: 170163 - protein, 315 aa, Heterodera glycines
  misc_feature (16)..(16): Xaa can be any naturally occurring amino acid
  misc_feature (298)..(298): Xaa can be any naturally occurring amino acid
  Homolog annotation: Hit_ID=AAD27589.1; Match level="QueryCoverage =99%, HitCoverage=51%, E-value=1e-122, Identity=71%"; Hit description= chaperonine protein HSP60 [Onchocerca volvulus]
  Gene Ontology: Mol. function=heat shock protein activity; Cellular component=mitochondrion; Biological process=mitochondrial translocation
  Coding regions on vcDNA: vcDNA=SeqID_96586; Strand=+; Position=2-945
PQKLQLANKYRRPVLXIAEDVDGEALTTLVLNRLKVGLQVCAVKAPGFGDNRKNTLKDMAVSTGGTVFGEEASLIKLEDIQIQDFGEADEVTVTKDDTLILRGKGSQEDVEKRIASIQDELDASTSDYEKEKLNERLAKLSTGVALLKIGGASEVEVNEKKDRVTDALCATRAAVEEGIVPGGGVALLRALKKLDTLKPDNDDQKSGIKIVQKAIRQPISTIIANAGLEPSAIVEKALANAETNYRYDAMNDQFVNMLEAGIIYPDKRRARRRCTTRPALVSLMATTECVVTEIPKEXPTMPSGGGMGGMGGGMG

SEQ ID NO: 170164 - protein, 49 aa, Heterodera glycines; identical to SEQ ID NO: 164794
  Coding regions on vcDNA: vcDNA=SeqID_96587; Strand=-; Position=88-237

SEQ ID NO: 170165 - protein, 141 aa, Heterodera glycines
  Coding regions on vcDNA: vcDNA=SeqID_96588; Strand=-; Position=46-471
LNEWREWTRNPNGFSSHCPPKCPPSARPFLCQFPSLLHSATPRSSVRDQAAPAENALRHIAVIAHPPAEKRKAQDRSQFALLRHAFPPLRPPPLHSHIPHKNPQSVYQRDENSQHFYDYWSAAPPPNVCCVKNNSLHFCGQ

SEQ ID NO: 170166 - protein, 157 aa, Heterodera glycines
  Homolog annotation: Hit_ID=AAM78147.1; Match level="QueryCoverage =74%, HitCoverage=42%, E-value=2e-09, Identity=33%"; Hit description =An1 protein [Paracentrotus lividus]
  Coding regions on vcDNA: vcDNA=SeqID_96589; Strand=+; Position=57-527
MGKNKKPFIDRKSAVNYTLNNRELEETQRISDYKSFSFRSLDKRFEGIYEDYANEEEEGAEEMDDEEGQTGADSAIFRSLLADGQSQRSCEERFHRELPDSELKGAVLRYAKAMEIGKGRAEPTEDILVDSAKRSRWDCESILSMHSTLYNHPTEIR

SEQ ID NO: 170167 - protein, 182 aa, Heterodera glycines
  Coding regions on vcDNA: vcDNA=SeqID_96590; Strand=+; Position=2-547
SWSSPRWRPLFTSGSPGLQDFRTRVLAMAIARQFRYSIYLLLVLVRFSLHQSAELEDLQRLCPDLKGAFCSHCDHKSVEQICPIECNFCSTFRSNETPKFFGNAAENLIELKRQCATIRLAFCNVCKITSINELCVEECLDCEAGLRDEQKEVVPLVQTWQQSAGDGLAIGDDGTNSAGEAA

SEQ ID NO: 170168 - protein, 129 aa, Heterodera glycines; identical to SEQ ID NO: 162507
  Homolog annotation: Hit_ID=CAE73476.1; Match level="QueryCoverage =66%, HitCoverage=70%, E-value=5e-23, Identity=56%"; Hit description =Hypothetical protein CBG20928 [Caenorhabditis briggsae]
  Coding regions on vcDNA: vcDNA=SeqID_96591; Strand=+; Position=33-422

SEQ ID NO: 170169 - protein, 95 aa, Heterodera glycines
  Homolog annotation: Hit_ID=CAG02850.1; Match level="QueryCoverage =95%, HitCoverage=74%, E-value=2e-27, Identity=67%"; Hit description =unnamed protein product [Tetraodon nigroviridis]
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_96592; Strand=+; Position=22-309
MAPAKKKWSKGKVKDKANNAVTLDKATYDKIYKEVPTWRLITPSVLVDRLRLNGSLARVALKELADKGEIKLVSAHGSQLIYTRSTIGAEPVAAA

SEQ ID NO: 170170 - protein, 100 aa, Heterodera glycines
  Coding regions on vcDNA: vcDNA=SeqID_96593; Strand=+; Position=261-560
MPRRATTLARRNSPTSTPSSTRSTPTRTWATCKSTLSVPTRPRVTISASRRCRTLVSCRRRVTLGPAITAMATGPPRVTSRPTSPKPTKRPGTTLARRRA

SEQ ID NO: 170171 - protein, 159 aa, Heterodera glycines
  Coding regions on vcDNA: vcDNA=SeqID_96594; Strand=+; Position=3-479
SLTINNDILDDVIAFIKRSELAQNFSLVSHHFNSLAQRRMHDANAHWVEGDCVFIANATTTRMIIPRGNNGGFEEVPVPTVAQPSYVLGFRGTIHFNGTLSDNALAFFRHALPPPTTLYRFSVLDEFYRANGLLSPFKTTERINTFLDTCVHLVELGGD

SEQ ID NO: 170172 - protein, 154 aa, Heterodera glycines
  Coding regions on vcDNA: vcDNA=SeqID_96595; Strand=+; Position=1-462
LSNKSLISFFLLQIFFVSFASRAVKRSLYSAKFPLALNEIRSVVSLNSYFSKIVQFCSGVLLTENIVLTAAHCILSDEFGLADYIHVKGFGWNAHSTEFVIRTDFIFLDLEDSICADIALIFLPPKVTGIFGTAKFTKFTESEWSNKSDSDSKI

SEQ ID NO: 170173 - protein, 56 aa, Heterodera glycines
  Coding regions on vcDNA: vcDNA=SeqID_96596; Strand=-; Position=79-249
KVHIYYICDQISKIAKTKSGGNNSQKFKKIYFLRKSKFLINGGEWHTNVAQNKMFI

SEQ ID NO: 170174 - protein, 135 aa, Heterodera glycines
  Coding regions on vcDNA: vcDNA=SeqID_96597; Strand=+; Position=72-476
MASFILFIILIITKANNSMGQDSGTNDVQLTLVNGCPYKIYVAGAVQVNLTVNERQTKNVPSVSTAQRLWANTDCDSENNPLCNLQAAMPPISLFEWTFDADGKQTYDVSYVDGANVPISVRVLNCPGVNFNKKL

SEQ ID NO: 170175 - protein, 148 aa, Heterodera glycines
  Homolog annotation: Hit_ID=NP_510509.2; Match level="QueryCoverage =95%, HitCoverage=24%, E-value=4e-45, Identity=59%"; Hit description =laminin A (XP714) [Caenorhabditis elegans] emb|CAB05478.2| Hypothetical protein F09B12.3 [Caenorhabditis
  Coding regions on vcDNA: vcDNA=SeqID_96598; Strand=+; Position=67-557
FNLLYQLHCWVRAIVANQMARTAREWCHIFKRFNSGTYNNQWLIVDYNKFKPYTELPDHGLFYVLEQMPTIVLYQDMTQWLKQNGYFASYNIPFFKKTSLISGFEQKGNEFYWFSWKSCPRAKIFARDQHKVVDVDSLTKLMRYNDYT

SEQ ID NO: 170176 - protein, 77 aa, Heterodera glycines
  Homolog annotation: Hit_ID=CAE70177.1; Match level="QueryCoverage =84%, HitCoverage=17%, E-value=2e-09, Identity=40%"; Hit description =Hypothetical protein CBG16650 [Caenorhabditis briggsae]
  Coding regions on vcDNA: vcDNA=SeqID_96599; Strand=+; Position=3-233
LFSVFPQNLFGYSCKSLSGKEVDWFVAYKLPDLGSDGDGTAFLYSDANTAAWRLSDKNVEDKTSAIGLTVSQLFTAK

SEQ ID NO: 170177 - protein, 155 aa, Heterodera glycines
  Homolog annotation: Hit_ID=NP_502129.1; Match level="QueryCoverage =98%, HitCoverage=28%, E-value=7e-41, Identity=54%"; Hit description =glucose-6-phosphate dehydrogenase and Glucose-6-phosphate dehydrogenase (60.2 kD) (4M83) [Caenorhabditis
  Gene Ontology: Mol. function=glucose-6-phosphate 1-dehydrogenase activity; Cellular component=cytoplasm; Biological process=pentose -phosphate shunt
  Coding regions on vcDNA: vcDNA=SeqID_96600; Strand=+; Position=87-551
MVLCERTFSLSEPLLPETIKFIKESLEKQGELHFELPHVFVVFGASGDLAKKKIYPTLWWLFRDGLLPRDTHIIGYARSRLTLETLRTAFEKHCNVRDGERPKFEQYIKHCSYISGQYDTDEGLIALDRAIIEMEHTFKKPANRLFYLALPPEVF

SEQ ID NO: 170178 - protein, 96 aa, Heterodera glycines; identical to SEQ ID NO: 164778
  Homolog annotation: Hit_ID=CAG13232.1; Match level="QueryCoverage =100%, HitCoverage=21%, E-value=2e-29, Identity=62%"; Hit description= unnamed protein product [Tetraodon nigroviridis]
  Coding regions on vcDNA: vcDNA=SeqID_96601; Strand=+; Position=1-291

SEQ ID NO: 170179 - protein, 91 aa, Heterodera glycines
  Coding regions on vcDNA: vcDNA=SeqID_96602; Strand=-; Position=2-274
PQTWYQQLPSLVWPYQTILRYLKRKQKKFLTKKWLSLFSHFFTANLVPTVAFSCLALSNIFFLIFLPQTWYQQLPSFVWPYQTILRYLKRK

SEQ ID NO: 170180 - protein, 82 aa, Heterodera glycines
  Homolog annotation: Hit_ID=NP_498776.1; Match level="QueryCoverage =98%, HitCoverage=73%, E-value=5e-30, Identity=74%"; Hit description =heat shock protein (hsp-12.2) [Caenorhabditis elegans] gb|AAA27953.1| Heat shock protein protein 12.2 [Ca
  Gene Ontology: Mol. function=chaperone activity; Cellular component =cytoplasm; Biological process=muscle contraction
  Coding regions on vcDNA: vcDNA=SeqID_96603; Strand=+; Position=2-250
NTKDKFEVGLDVQFFAPQEIEVKVSGQDVIIHCLHEIRKDQHGSVKREIHRQYRLPNDVDAATLKSHLSTRGVLTLTASKKD

SEQ ID NO: 170181 - protein, 132 aa, Heterodera glycines
  Coding regions on vcDNA: vcDNA=SeqID_96604; Strand=+; Position=3-398
NTKSQLMSGQSAQKDGKIAATILIDPVTQKSANITIRTPAQQLRMEQIEVPYKVRPFAFDSPRSAQQKHSLAQLVHPFASIPPPMDRLKGQRELFEDLSTGPPSLQWYTGGGKKGGQTPPIWGGCKKSAPPP

SEQ ID NO: 170182 - protein, 179 aa, Heterodera glycines
  Coding regions on vcDNA: vcDNA=SeqID_96605; Strand=+; Position=16-552
MTYRDGDRPQRKTWVQKQTEANKSTPTLNLSSSGNGGPSVEGRTRDTHLSGDELADNSPQKGQQQILNQTFTKSSTKEYDSATLIAPVSNGTESLNNRSGGLVLEDVCDSNSEMTPEMQAKRRAILASQIRRKERIMARSEEKETEEMDRLQVKMQRMEQAEMRRMEREQRRQKLLEDY

SEQ ID NO: 170183 - protein, 140 aa, Heterodera glycines; identical to SEQ ID NO: 164771
  Homolog annotation: Hit_ID=NP_498397.1; Match level="QueryCoverage =90%, HitCoverage=28%, E-value=4e-09, Identity=38%"; Hit description =zinc finger protein -related like (43.1 kD) (3H473) [Caenorhabditis elegans] gb|AAB47598.1| Hypothetical
  Gene Ontology: Biological process=embryogenesis and morphogenesis
  Coding regions on vcDNA: vcDNA=SeqID_96606; Strand=+; Position=1-423

SEQ ID NO: 170184 - protein, 177 aa, Heterodera glycines
  Homolog annotation: Hit_ID=NP_498518.1; Match level="QueryCoverage =80%, HitCoverage=56%, E-value=9e-35, Identity=49%"; Hit description =pyridoxamine oxidase (3I53) [Caenorhabditis elegans] gb|AAA21167.1| Hypothetical protein F57B9.1 [Caenorh
  Gene Ontology: Mol. function=pyridoxamine-phosphate oxidase activity; Biological process=coenzymes and prosthetic group metabolism
  Coding regions on vcDNA: vcDNA=SeqID_96607; Strand=+; Position=35-565
MFLKRRISEPSDEDEKQRTNQIPIDNNSCVDGIPLNIQSLRKTYVDREEPFLLEKDMLSCPFDQFSIWFGNAITQTDLKYEEVNGFALSTVSRNGRPSSRMLLLKGFSKVGGFVFFTHSNSKKGKELSENPYVSALFYWPKVNRQIRIEGRVEILGEEVADVYWSKRPIESPRGLRS

SEQ ID NO: 170185 - protein, 154 aa, Heterodera glycines
  Coding regions on vcDNA: vcDNA=SeqID_96608; Strand=+; Position=3-464
KMKLGICISWGRTGGRLMVPPSNEPIRPFTLIWNKTDGLVALLGQKLEKGTWVLFTLSTRTAFLHSVDRKLVDRVSITDQRRETAVDSMNIQVMAFVRSFRRYNDYYRIGMDQLIGWVLVSEDSFVRRVVLQENLAAQMSIIFQHDCVRGFNWV

SEQ ID NO: 170186 - protein, 159 aa, Heterodera glycines
  Homolog annotation: Hit_ID=CAE63753.1; Match level="QueryCoverage =100%, HitCoverage=37%, E-value=4e-60, Identity=61%"; Hit description= Hypothetical protein CBG08288 [Caenorhabditis briggsae]
  Gene Ontology: Mol. function=transcription co-repressor activity; Cellular component=cytoplasm; Biological process=small GTPase mediated signal transduction
  Coding regions on vcDNA: vcDNA=SeqID_96609; Strand=+; Position=3-479
APQQIPQTSQVIAATVISATGASGVLQLGQQSSNSEFLSAFECPVCLDYMLPPYLQCPSGHLVCGNCRPKVTACPTCRGPIPSIRNLGMEKIAASLQFPCKFAHSGCTQFFYHHEKVEHEEICEFRPYQCPCPGASCKWQGSLADVMSHLMKLHKSITT

SEQ ID NO: 170187 - protein, 78 aa, Heterodera glycines
  Coding regions on vcDNA: vcDNA=SeqID_96610; Strand=-; Position=94-330
FCHIVFLKQINKERNYNWETIKSSKTLSLQWLTDVLLHSLHSKIHRFYAFCHRFSVVIATIHHVKEIRDKRARPTIFL

SEQ ID NO: 170188 - protein, 59 aa, Heterodera glycines
  Coding regions on vcDNA: vcDNA=SeqID_96611; Strand=-; Position=54-233
KCINLLSTVKKSDDKQNEYPKRNKRSSFLFIQILFGFFAGNSSLTTDGQSTPSSSKTIS

SEQ ID NO: 170189 - protein, 209 aa, Heterodera glycines
  Homolog annotation: Hit_ID=NP_998658.1; Match level="QueryCoverage =99%, HitCoverage=50%, E-value=4e-68, Identity=57%"; Hit description =DnaJ subfamily A member 2 [Danio rerio] gb|AAH68384.1| DnaJ subfamily A member 2 [Danio rerio] gb|AAH4804
  Gene Ontology: Mol. function=heat shock protein activity; Cellular component=cytosol; Biological process=G1 phase of mitotic cell cycle
  Coding regions on vcDNA: vcDNA=SeqID_96612; Strand=+; Position=2-628
SRKGETTVQPLQVSLEDLYKGKNTKLQLTKKVLCKTCNGIGGKQGSVRKCDRCQGSGKVFRTRQIGPGMIQQMAARCDQCSGEGEMVDEKDRCKKCVGRKTVQEQKIIEVKITPGMRDNQKIVFYGEGDQEPGIEPGDVVLVIKTKSHEQFERKGDDLFMKKTVSLADALCGFTTTIKHLDGRQITLTTMPGDIIKPESIRGAIQEGMP

SEQ ID NO: 170190 - protein, 159 aa, Heterodera glycines
  Coding regions on vcDNA: vcDNA=SeqID_96613; Strand=+; Position=10-489
STSIFSLSLTIRGHCSDPLVVCTSSRTFGAKDVEVSNTLLLLDGTPNGAGANQQHIVSITNRFVELSEAFLPDQTFRLKALLEQNLLDFYNENAPAAEESKGIKLNELLDHVQISEQQLREELAKFAVVEPAEGVATFTRLILNLEIYLLCICSLIIVR

SEQ ID NO: 170191 - protein, 141 aa, Heterodera glycines; identical to SEQ ID NO: 162246
  Homolog annotation: Hit_ID=NP_491085.1; Match level="QueryCoverage =72%, HitCoverage=81%, E-value=4e-15, Identity=43%"; Hit description =NADH dehydrogenase Fe-S protein 5 like (1D570) [Caenorhabditis elegans] gb|AAF60773.1| Hypothetical prote
  Coding regions on vcDNA: vcDNA=SeqID_96614; Strand=+; Position=36-461

SEQ ID NO: 170192 - protein, 158 aa, Heterodera glycines
  Homolog annotation: Hit_ID=EAK83446.1; Match level="QueryCoverage =98%, HitCoverage=36%, E-value=2e-71, Identity=78%"; Hit description =hypothetical protein UM02408.1 [Ustilago maydis 521] ref|XP _400023.1| hypothetical protein UM02408.1 [Usti
  Gene Ontology: Cellular component=actin filament; Biological process =signal transduction
  Coding regions on vcDNA: vcDNA=SeqID_96615; Strand=+; Position=3-476
LSVSFSADNRQIVSGSRDKTIKLWNTLGECKYNIEGAHTEWVSCVRFSPNPENPIIISAGWDKLVKVWDLSKSKLRTNHIGHKGYINSLAVSPDGSLCASGGKDGIPMLWDLNDGKHLYSLDAGEEIHALCFSPNRYWLCAATTSGIRIWDLQTKEHI

SEQ ID NO: 170193 - protein, 51 aa, Heterodera glycines; identical to SEQ ID NO: 146846
  Coding regions on vcDNA: vcDNA=SeqID_96616; Strand=-; Position=124-279

SEQ ID NO: 170194 - protein, 149 aa, Heterodera glycines
  Homolog annotation: Hit_ID=NP_499743.2; Match level="QueryCoverage =71%, HitCoverage=23%, E-value=3e-42, Identity=73%"; Hit description =amino acid transport protein (51.0 kD) (3O401) [Caenorhabditis elegans] emb|CAA16336.2| Hypothetical prot
  Coding regions on vcDNA: vcDNA=SeqID_96617; Strand=+; Position=34-480
MSSNPVEGTENLGQLRQTAPQQTTAADPSSLNSSNSAAVESMDSEGVYLFADRTQSSNSLTPEQAFVHMVKAMLGTGLLSLPYAFSHSGLYLGLILLVLICLVCMFCMRQIVFAAHYICTKNGREIIDYANIMRGAVEAGPSWISSRGY

SEQ ID NO: 170195 - protein, 202 aa, Heterodera glycines
  Coding regions on vcDNA: vcDNA=SeqID_96618; Strand=+; Position=2-607
SFVHFAIPMSPPKRAKVSADDDGETISDDGEPSTSAGAKRKQKASKPRQRKAHEAFILLVDVGRSSAENSAGAQSDHGTTTDLDRSVQIVDWVLSRKIFTESSDRFSLMFFGHENTSSDDHPNVYVHNEQFATARVEWLHVLQNEVQTNVKCPGDYVDALYAALDALKVHFDDAKEAGEPMSGATVTLVSNLSGLDDERAVM

SEQ ID NO: 170196 - protein, 180 aa, Heterodera glycines
  Coding regions on vcDNA: vcDNA=SeqID_96619; Strand=+; Position=10-549
MALSLFLLLVGTIIANCNGDPKMKSVEEKSVPPAAFWPYILHPKTPRHKSEEREDYYDAVRAEEEEAEKATLTSSTAANRGNEKQQEEEEGEEEARQLQQMMALLLANIDPVPMFTANSEKPKTIAQTMAPTKAATALTMSKVDGETYDERTEAGKDDEETDDDDDEEHETRKMVDTELK

SEQ ID NO: 170197 - protein, 162 aa, Heterodera glycines
  Homolog annotation: Hit_ID=NP_495254.2; Match level="QueryCoverage =51%, HitCoverage=22%, E-value=4e-14, Identity=48%"; Hit description =inosine/uridine-preferring nucleoside hydrolase (41.1 kD) (2G555) [Caenorhabditis elegans] gb|AAN65330.1|
  Gene Ontology: Biological process=nucleotide metabolism
  Coding regions on vcDNA: vcDNA=SeqID_96620; Strand=+; Position=2-487
IALVRMCKAHRGMTVVAIGPLTNIAMAVRLDPDFLSYIDKLYIMGGSLLAKGNATRTAEFNFACDPEAAHIVFTSSTKHSTRAPKIVLAPLELTFDQAFDWDLIARLSDPSRHAAHPWSKFLYRITAALRRMFRSPAHLDAVAQAKDKHQARRACAAAPCCA

SEQ ID NO: 170198 - protein, 95 aa, Heterodera glycines
  Coding regions on vcDNA: vcDNA=SeqID_96621; Strand=+; Position=25-312
RRVRSLNFSTKFMCSDNNELLKDPSAAHKLTLLLANRHRCHKSRKTLADFLRKKFHFHNRRVKNCATNLTTTTKFFTDIRKGCYTKSIERGGGIA

SEQ ID NO: 170199 - protein, 141 aa, Heterodera glycines; identical to SEQ ID NO: 149838
  Coding regions on vcDNA: vcDNA=SeqID_96622; Strand=+; Position=28-453

SEQ ID NO: 170200 - protein, 119 aa, Heterodera glycines; identical to SEQ ID NO: 162461
  Homolog annotation: Hit_ID=CAE68944.1; Match level="QueryCoverage =80%, HitCoverage=26%, E-value=3e-14, Identity=47%"; Hit description =Hypothetical protein CBG14924 [Caenorhabditis briggsae]
  Gene Ontology: Mol. function=ATP dependent RNA helicase activity; Biological process=nucleobase, nucleoside, nucleotide and nucleic acid metabolism
  Coding regions on vcDNA: vcDNA=SeqID_96623; Strand=+; Position=2-361

SEQ ID NO: 170201 - protein, 113 aa, Heterodera glycines; identical to SEQ ID NO: 162232
  Homolog annotation: Hit_ID=CAE74331.1; Match level="QueryCoverage =100%, HitCoverage=100%, E-value=2e-31, Identity=64%"; Hit description=Hypothetical protein CBG22044 [Caenorhabditis briggsae]
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_96624; Strand=+; Position=24-365

SEQ ID NO: 170202 - protein, 151 aa, Heterodera glycines
  Homolog annotation: Hit_ID=NP_462633.1; Match level="QueryCoverage =98%, HitCoverage=68%, E-value=1e-44, Identity=67%"; Hit description =orotate phosphoribosyltransferase [Salmonella typhimurium LT2] gb|AAL22592.1| orotate phosphoribosyltrans
  Gene Ontology: Mol. function=orotate phosphoribosyltransferase activity; Cellular component=cytoplasm; Biological process =pyrimidine base biosynthesis
  Coding regions on vcDNA: vcDNA=SeqID_96625; Strand=+; Position=23-475
QYKGVLQFGSFKLKSGRTSPYFFNAGLFNTGDLLNQVGRFYASAILDHEATFRPSVLFGPAYKGIPLVATTAVNLAVMGHNMPYVFNRKEAKDHGEGGSLVGMSKLQGERVLIVDDVITAGTAIRESFPLLRDHNGATVAGVLVALDRMER

SEQ ID NO: 170203 - protein, 68 aa, Heterodera glycines
  Coding regions on vcDNA: vcDNA=SeqID_96626; Strand=-; Position=3-206
RALRARFLIFFGGYSAASRPQDGRFAPVFKLCREIRTLRLKEVHLVPVSCSPGDPLVVGRPPPRGAPA

SEQ ID NO: 170204 - protein, 60 aa, Heterodera glycines; identical to SEQ ID NO: 167207
  Coding regions on vcDNA: vcDNA=SeqID_96627; Strand=-; Position=329-511

SEQ ID NO: 170205 - protein, 58 aa, Heterodera glycines; identical to SEQ ID NO: 164747
  Coding regions on vcDNA: vcDNA=SeqID_96628; Strand=-; Position=2-175

SEQ ID NO: 170206 - protein, 260 aa, Heterodera glycines
  Homolog annotation: Hit_ID=NP_495261.1; Match level="QueryCoverage =89%, HitCoverage=59%, E-value=4e-85, Identity=66%"; Hit description =beta-ureidopropionase (43.2 kD) (2G578) [Caenorhabditis elegans] gb|AAK31488.1| Hypothetical protein F13H
  Gene Ontology: Mol. function=nitrilase activity
  Coding regions on vcDNA: vcDNA=SeqID_96629; Strand=+; Position=127-906
MAEENTNQSEGLDFFLNRSGWTDAQLEEVIRLLYGKRLQQLSIAQRFLDSAQEANFELKGFQMVAQEEQCRRPKKMRVAAIQNKIVLSTSAPVQAQRDALHQRVGKMIDAAARAGAQIVCLQEAWTMPFAFCTRERLPWTEFGESAEDGATTKFLSELAKRLGVVIISPILERDIHKDDLLWNTAVIISQTGAVIGKTRKNHIPRVGDFNESTYYMESTLGHPVFETAFGAKIAVNICYGRHHPQNWMMYALNGVLLLML

SEQ ID NO: 170207 - protein, 75 aa, Heterodera glycines
  Coding regions on vcDNA: vcDNA=SeqID_96630; Strand=+; Position=253-477
LSSVSPLLVVAFLVPQKRPPSVSPPPLNSPPPISSAHQNQRLLVCQPQLPPRQVLSVLRQQSFQLRLARPLCRRF

SEQ ID NO: 170208 - protein, 107 aa, Heterodera glycines
  misc_feature (43)..(43): Xaa can be any naturally occurring amino acid
  misc_feature (95)..(95): Xaa can be any naturally occurring amino acid
  Homolog annotation: Hit_ID=CAD90560.1; Match level="QueryCoverage =100%, HitCoverage=20%, E-value=4e-40, Identity=68%"; Hit description= cytochrome c oxidase subunit I [Strongyloides stercoralis] ref|NP _937900.1| cytochrome c oxidase subunit
  Gene Ontology: Mol. function=cytochrome c oxidase activity; Cellular component=mitochondrial inner membrane; Biological process =mitochondrial electron transport, cytochrome c to oxygen
  Coding regions on vcDNA: vcDNA=SeqID_96631; Strand=-; Position=1-321
LLILTLPVLAGAITLLLVDRNFNGNFFDRTGGGNPLVFQHLFXFFGHPEVYVLILPAFGLVRLTIQFYTGKKILFGYLGIIYAIISIGFIGCLVXAHHIFVVGIDID

SEQ ID NO: 170209 - protein, 134 aa, Heterodera glycines; identical to SEQ ID NO: 164744
  Homolog annotation: Hit_ID=NP_492711.1; Match level="QueryCoverage =85%, HitCoverage=10%, E-value=3e-24, Identity=48%"; Hit description =glutamyl (E) tRNA Synthetase, glutaminyl (Q) tRNA Synthetase (125.2 kD) (ers-2) [Caenorhabditis elegans]
  Gene Ontology: Cellular component=mitochondrion; Biological process =protein complex assembly
  Coding regions on vcDNA: vcDNA=SeqID_96632; Strand=+; Position=3-407

SEQ ID NO: 170210 - protein, 85 aa, Heterodera glycines
  Homolog annotation: Hit_ID=NP_498705.1; Match level="QueryCoverage =95%, HitCoverage=86%, E-value=8e-32, Identity=83%"; Hit description =protein similar to human bone marrow protein BM-002 (9.8 kD) (3I949) [Caenorhabditis elegans] gb|AAA28214
  Coding regions on vcDNA: vcDNA=SeqID_96633; Strand=+; Position=2-259
GKVTFKITLTSDPKLPFKVLSVPENAPFTAVLKFAAEEFRVDPSTSAIITDEGVGVNPAQKASDIFMKYGSELRLIPRDRVGQGE

SEQ ID NO: 170211 - protein, 148 aa, Heterodera glycines
  Homolog annotation: Hit_ID=AAK39520.1; Match level="QueryCoverage =97%, HitCoverage=29%, E-value=7e-17, Identity=35%"; Hit description =BTB domain protein [Homo sapiens]
  Gene Ontology: Mol. function=protein binding
  Coding regions on vcDNA: vcDNA=SeqID_96634; Strand=+; Position=34-477
MASMSDRMKLMLSSGKGADVHFLVGQSDAKKILAAHKTILISASDVFETMFRFDAKNANVGNVNNPVEVPDVEVGAFNVMLSFIYADDLSQLDGDNAMAVLNTAKKYNITGLVTAIKNMPIAKICGDVFMTLAQSRLFEESDLVERSL

SEQ ID NO: 170212 - protein, 38 aa, Heterodera glycines
  Coding regions on vcDNA: vcDNA=SeqID_96635; Strand=+; Position=37-153
KIIFYFDDATHLFSFLSFMKRAIHSSFIDHLYTLYTQN

SEQ ID NO: 170213 - protein, 204 aa, Heterodera glycines
  Homolog annotation: Hit_ID=NP_497039.1; Match level="QueryCoverage =97%, HitCoverage=46%, E-value=2e-49, Identity=81%"; Hit description =putative protein (67.0 kD) (2O915) [Caenorhabditis elegans] emb|CAB07587.1| Hypothetical protein C38C6.6
  Coding regions on vcDNA: vcDNA=SeqID_96636; Strand=+; Position=2-613
RKGLSFKVVVDMNGNTVVYNDRDVPIGTGSVRKVGERSYEAVISKNLFITRLKDVRRGPCCRELTGEECTEPIKLANPQFSHPSQRDDNGTTRLTWPDCFDMSIDVTLPPTVHINRLAMNYWQKQGAIDVWMKFFERAPNRAEMEKEFFSQLDNPLLGKAFKLAIIGEWLAANSLDQGSYTPTNSELLEFWVSKRAPDRLLACE

SEQ ID NO: 170214 - protein, 154 aa, Heterodera glycines
  Coding regions on vcDNA: vcDNA=SeqID_96637; Strand=+; Position=16-477
RRTFCLNQMVRILLPNGESANVSPSESVEEAIKHCVGGDISSQNDYSLVFFGRKLNSDQRLADIPHLDGESRSVRLVCRKSPGVSIEKNLADVDKLRSQCRTLYQNLGEELQQKLETYMVDDNNAIFNSILKDHPELVHDPIALPIVKDLRLLV

SEQ ID NO: 170215 - protein, 154 aa, Heterodera glycines
  Coding regions on vcDNA: vcDNA=SeqID_96638; Strand=+; Position=28-489
MKKHVTFTPSIGDDVHSTNVSSVAESEFSVKERAEVPEIFKKLADDAFQILPLPDIDPTVTSTPAVVNNLIEAVESLDSRMPLAFQEQQQILKMQGEMLQLGVSCKEHYKKIHEQSVMRYNLEKSVNKNIDDLKEGAVVAQKLVKAKSAYEEMV

SEQ ID NO: 170216 - protein, 412 aa, Heterodera glycines
  Coding regions on vcDNA: vcDNA=SeqID_96639; Strand=+; Position=1-1236
PTRLRRFAICVGVDEENGTCLMVYENDLNAIEVRMVFSGVQIGKWYRFDLAKGTRRNWEVAEERLPTRIMPRGDAGSGGTRGDRIQLCLPIFFVPNFKCFGCTWRVTSPTSFNDKMHFNFVSPRLEAPGKINFSEERLAELNIRPGEQCFAFLTLDCQGPGPSIKPPQWTLDAVEHFHRVNVDPLAPSVLSVSLGASKEWGILLDLVIESEDERNGMGFILCLRDGKFAFGRILKTEGHNDSCWRANVGDTVGFSLIDVDCFNYPVRLALNVIAWQSPAFTSVDSDVLSDQFPQESLPEFPSVRLISKSTGKMAQHLFELCFPIDDSQMSCLRMGSLKVDRLGVLIDLNGDLLSAWSNMKRKGTDAISSLLLARVRARFSSLPDQQQPLWMVAEMLEIAKMRVDTESKRQTL

SEQ ID NO: 170217 - protein, 90 aa, Heterodera glycines; identical to SEQ ID NO: 162451
  Coding regions on vcDNA: vcDNA=SeqID_96640; Strand=+; Position=1-273

SEQ ID NO: 170218 - protein, 153 aa, Heterodera glycines
  Coding regions on vcDNA: vcDNA=SeqID_96641; Strand=+; Position=3-461
VMSLYFNVLLVLLVLLVHLFRRYSGRLVAAVLQRLLHARAAHIYGLGWFALRHGELLLANGLHLEVRELRVHSLFNWWWTTTAPTVDSAANDGGGQRMALNVRVSVGTIRVGKQLADEEGSRNATSSICDGQNPLIENCGVLDSVSIHLSRPG

SEQ ID NO: 170219 - protein, 81 aa, Heterodera glycines
  Coding regions on vcDNA: vcDNA=SeqID_96642; Strand=+; Position=147-389
LHHPLLQKFTSFFSRILPHMFWSFFYNQWLRFSQQKFHLLLHDERLFLFLADFMLASALITFVTFTFLDACSYGRYALVFL

SEQ ID NO: 170220 - protein, 60 aa, Heterodera glycines
  Homolog annotation: Hit_ID=CAE60650.1; Match level="QueryCoverage =93%, HitCoverage=20%, E-value=7e-15, Identity=62%"; Hit description =Hypothetical protein CBG04296 [Caenorhabditis briggsae]
  Gene Ontology: Mol. function=chromatin binding; Cellular component =nucleus; Biological process=loss of chromatin silencing
  Coding regions on vcDNA: vcDNA=SeqID_96643; Strand=+; Position=1-183
DHIKLEIVFEIFENIKEDVEWELVFVGTDGREEHDQVLDSVLIGPIQEGRHKFLFEVLCL

SEQ ID NO: 170221 - protein, 71 aa, Heterodera glycines
  Coding regions on vcDNA: vcDNA=SeqID_96644; Strand=+; Position=3-218
RSIASEGERSLREGDAVNGIKILEKALQCNTFDLSLQCSLHSQLGNAYYARGDYRKARFPSTVRSFYSPTH

SEQ ID NO: 170222 - protein, 159 aa, Heterodera glycines
  Coding regions on vcDNA: vcDNA=SeqID_96645; Strand=+; Position=3-479
GILQRYEMQQFRLSCANFESESSCCSTSQQMEIIVDSESDSNLTRCPCCRCAQVNLICANCLNTNVVRIGKVREDKRRLLRSKSAICHLIQNALADEIKFEGEFHQLSRSIEEIRAKIAHKKDQVGRLRQRISHTESQSERNRQNVLLLEKKMVSHSDR

SEQ ID NO: 170223 - protein, 104 aa, Heterodera glycines; identical to SEQ ID NO: 162444
  Homolog annotation: Hit_ID=NP_038927.1; Match level="QueryCoverage =81%, HitCoverage=94%, E-value=5e-25, Identity=57%"; Hit description =translocase of inner mitochondrial membrane 13 homolog a [Mus musculus] gb|AAD39996.1| small zinc finger-
  Coding regions on vcDNA: vcDNA=SeqID_96646; Strand=+; Position=7-321

SEQ ID NO: 170224 - protein, 63 aa, Heterodera glycines
  Coding regions on vcDNA: vcDNA=SeqID_96647; Strand=-; Position=0-188
HQQSLYSALIIIRSFTFSSCILSPLLLRLGHRRRLTPLRPVQALRRRFLPVVPAHAPLPAEQA

SEQ ID NO: 170225 - protein, 84 aa, Heterodera glycines
  Coding regions on vcDNA: vcDNA=SeqID_96648; Strand=+; Position=26-277
RIGAAYVRIHCRRAAAVALLGLMNWTISSDCQRHTTIRPYLSFSNAIVMQKPPHNEGLRAKKCHLLFCCYFMYLNPFYCINANL

SEQ ID NO: 170226 - protein, 155 aa, Heterodera glycines
  Homolog annotation: Hit_ID=AAS54865.1; Match level="QueryCoverage =100%, HitCoverage=76%, E-value=2e-55, Identity=70%"; Hit description= AGR375Wp [Ashbya gossypii ATCC 10895] ref|NP_987041.1| AGR375Wp [Eremothecium gossypii]
  Gene Ontology: Cellular component=eukaryotic 48S initiation complex; Biological process=protein biosynthesis
  Coding regions on vcDNA: vcDNA=SeqID_96649; Strand=+; Position=15-479
MGISRDSRHKRAHTGAKRAHYRKKRKFELGRQAANTKLGATRVHQVRVRGGNIKFRALRLDTGNFSWGSESCTRKTRILGVVYNASNNELVRTNTIVKGGIVEIDATPFRQWYESHYVQALGRKQKDVAEVEELNKKRSSRVLRKVEARQANAKV

SEQ ID NO: 170227 - protein, 92 aa, Heterodera glycines
  misc_feature (92)..(92): Xaa can be any naturally occurring amino acid
  Coding regions on vcDNA: vcDNA=SeqID_96650; Strand=+; Position=173-448
KLLQEISQTPSGRRKREKCHFWSGAISCGGKNANKKWHKHSLILTTLIEGLVVVENGETIGQQQEQELGTEKKPPVWVGTFLIWHNLWRNDX

SEQ ID NO: 170228 - protein, 45 aa, Heterodera glycines
  Coding regions on vcDNA: vcDNA=SeqID_96651; Strand=-; Position=27-164
IFTVSTDNRLVCRLRYHVFPLKLRLFFLLERKPTNRRFHFCFRFL

SEQ ID NO: 170229 - protein, 64 aa, Heterodera glycines; identical to SEQ ID NO: 164720
  Homolog annotation: Hit_ID=CAE71845.1; Match level="QueryCoverage =100%, HitCoverage=9%, E-value=2e-17, Identity=62%"; Hit description =Hypothetical protein CBG18887 [Caenorhabditis briggsae]
  Gene Ontology: Mol. function=protein binding; Cellular component =endomembrane system; Biological process=receptor mediated endocytosis
  Coding regions on vcDNA: vcDNA=SeqID_96652; Strand=+; Position=2-196

SEQ ID NO: 170230 - protein, 146 aa, Heterodera glycines
  Homolog annotation: Hit_ID=CAE61890.1; Match level="QueryCoverage =72%, HitCoverage=33%, E-value=6e-11, Identity=38%"; Hit description =Hypothetical protein CBG05881 [Caenorhabditis briggsae]
  Coding regions on vcDNA: vcDNA=SeqID_96653; Strand=+; Position=45-482
MLQETEAKSDSSKAPNEVALSSEGRISKLYVECFNEREKCLTVIGGGKMATALVHGLVSAGFIDKSEVNICSRSKETAFRWTTQGYQNAYTNDEFYSKVKKPRGIVIVAVKPQIFPGFLDELRKNGWLNFVGPEVLCVSIMAGIAL

SEQ ID NO: 170231 - protein, 115 aa, Heterodera glycines; identical to SEQ ID NO: 150586
  Homolog annotation: Hit_ID=AAO24602.1; Match level="QueryCoverage =88%, HitCoverage=72%, E-value=2e-20, Identity=49%"; Hit description =histone H3 variant [Trypanosoma brucei brucei] gb|AAO24601.1| histone H3 variant [Trypanosoma brucei bruce
  Gene Ontology: Mol. function=DNA binding; Cellular component =nucleosome; Biological process=establishment and/or maintenance of chromatin architecture
  Coding regions on vcDNA: vcDNA=SeqID_96654; Strand=+; Position=37-384

SEQ ID NO: 170232 - protein, 165 aa, Heterodera glycines
  Homolog annotation: Hit_ID=CAB38312.1; Match level="QueryCoverage =90%, HitCoverage=22%, E-value=2e-30, Identity=47%"; Hit description =molybdenum cofactor biosynthesis enzyme [Arabidopsis thaliana] gb|AAA97413.1| molybdenum cofactor biosynth
  Gene Ontology: Biological process=establishment of synaptic specificity at neuromuscular junction
  Coding regions on vcDNA: vcDNA=SeqID_96655; Strand=+; Position=22-519
VIRLTRTTYIDKSGPLLVELLQNSLLIRRGQKVTVANYTIVPDEKSKIVEYLREYSTKVDCILTSGGTGFSKRDVTPEATKEVIERECPGIAVALLKKGLDITPFAALTRLTAGIAANCLIINLPGSPKAVREGFEVIEPILSHAIAIVKGDESETSVLHKRTAL

SEQ ID NO: 170233 - protein, 112 aa, Heterodera glycines
  Coding regions on vcDNA: vcDNA=SeqID_96656; Strand=+; Position=27-365
MGVDSADDDSVPDPIVIKQGESLSLSQLVQKIEQLQNRTVQELLVTLRRRTYKMPVGPPDPNGDRFSQNGHLLVEDVVYNWVRKTRNSIHGIVQLHVLYEGIAMLDEVNYHF

SEQ ID NO: 170234 - protein, 118 aa, Heterodera glycines
  Coding regions on vcDNA: vcDNA=SeqID_96657; Strand=+; Position=3-359
QSHLFLMGVASADDDSVPDPIVIKLGESLSLSQLVQKIEQLQNRTVRGLLVTLRRRTYEMPVGPPDPNGDRFFQNGHLLVEDVVYNWVRKTRNSIHGIVQLHVLYEGIAMLDEVNYHF

SEQ ID NO: 170235 - protein, 83 aa, Heterodera glycines
  Homolog annotation: Hit_ID=CAE60420.1; Match level="QueryCoverage =92%, HitCoverage=15%, E-value=2e-11, Identity=44%"; Hit description =Hypothetical protein CBG04026 [Caenorhabditis briggsae]
  Gene Ontology: Biological process=regulation of protein activity, epigenetic
  Coding regions on vcDNA: vcDNA=SeqID_96658; Strand=+; Position=1-295
LWNNCGTHFRREVSSKHFVGELNYKCTNSIKVIALLRERARSLVKKWAENECSKDSSLSLVESLYRDLRDQGLSFELDSTTNN

SEQ ID NO: 170236 - protein, 160 aa, Heterodera glycines
  Homolog annotation: Hit_ID=CAE56905.1; Match level="QueryCoverage =59%, HitCoverage=24%, E-value=7e-35, Identity=69%"; Hit description =Hypothetical protein CBG24746 [Caenorhabditis briggsae]
  Gene Ontology: Biological process=sulfur amino acid metabolism
  Coding regions on vcDNA: vcDNA=SeqID_96659; Strand=+; Position=25-504
MPCSLATQSSVLKRRAPASPQQAKMHDKKRHFDESANNGQEKADKVPSKGDKVSPTNEEKKKNVAFATLAIHAGNEPEKWDMNQVVPPISLATTYKQQFAGMPKGHDYARGGNPTRDVLQQSIAALENARHCRVFSSGLSATAAMANWLHSGDHIIASDD

SEQ ID NO: 170237 - protein, 182 aa, Heterodera glycines
  Homolog annotation: Hit_ID=H88791; Match level="QueryCoverage=99%, HitCoverage=34%, E-value=2e-24, Identity=35%"; Hit description =protein T13F2.1 [imported] - Caenorhabditis elegans
  Coding regions on vcDNA: vcDNA=SeqID_96660; Strand=+; Position=59-604
MVLTDSAHADPKNAVPFRLRIDGHWVRVDERLLRAHPGSGAMLAYRDREASTVFHSFHAGSKRAYRWMTEHRENGGATAETEATTEANGTAAKTKKSNGTGAGAALWPDKIDAINMGKFGRSAEANEKICRSFDVLRSRVRSLGLLRADDAFFVLKFVQCVALIAFAVFLQSRDFFLASALC

SEQ ID NO: 170238 - protein, 78 aa, Heterodera glycines; identical to SEQ ID NO: 164707
  Homolog annotation: Hit_ID=NP_492717.1; Match level="QueryCoverage =97%, HitCoverage=98%, E-value=7e-28, Identity=77%"; Hit description =vertebrate NEDd8 related, ubiquitin-like, required for terminal differentiation of epidermis (ned-8) [Cae
  Coding regions on vcDNA: vcDNA=SeqID_96661; Strand=+; Position=4-240

SEQ ID NO: 170239 - protein, 114 aa, Heterodera glycines
  Coding regions on vcDNA: vcDNA=SeqID_96662; Strand=-; Position=25-369
KCLISNVILLQRIYNPSTQIDHYYCHRLSLSRFRLFDIPPFRRCSSACLSSSCNALYSSVYFSNSSLLPRSAASSKGRVGLNALKTTTVPTTIPVKKIAPFRRMNVTRLGPPFC

SEQ ID NO: 170240 - protein, 62 aa, Heterodera glycines
  Coding regions on vcDNA: vcDNA=SeqID_96663; Strand=-; Position=21-209
IRLVGTGILPRLVVQVHGFFGQNTGTGSPGKRESRDQVPVHFLSNGNFKIRALIEISTMLNN

SEQ ID NO: 170241 - protein, 123 aa, Heterodera glycines
  Coding regions on vcDNA: vcDNA=SeqID_96664; Strand=+; Position=3-374
QLRFVKKSNYHCILMILASSSKRLACQFLIRKVPHFAVTSSRKESNWSEVLDEAVPARKSYRDFQTLNGNQRDALAASLFFLLVNGHRLWAHRVLENTWWRGKRCIRGALDNTRGGKKRRGRG

SEQ ID NO: 170242 - protein, 23 aa, Heterodera glycines
  Coding regions on vcDNA: vcDNA=SeqID_96665; Strand=+; Position=13-84
MEKKQSQRQNFKALAEAKSKTKP

SEQ ID NO: 170243 - protein, 71 aa, Heterodera glycines
  misc_feature (20)..(20): Xaa can be any naturally occurring amino acid
  misc_feature (22)..(22): Xaa can be any naturally occurring amino acid
  Coding regions on vcDNA: vcDNA=SeqID_96666; Strand=-; Position=1-213
VLLVVAFCVISLGACASGPXAXIKKFIIHRFRGYSFGSFRSFARLRREIRCCRGLSCAVFSSPPMCQFGGF

SEQ ID NO: 170244 - protein, 255 aa, Heterodera glycines
  Coding regions on vcDNA: vcDNA=SeqID_96667; Strand=+; Position=3-767
SLSSDIMPFLFPSIVTTNNTAFNRINDKSANVRQKLDMMETALVHLTTNKCQLNFSAEKTRSDIRRATDKHISMLRERELKLFEEVDHIHQREQQLIEEQMEQLNQAIGTSKFVVEKMAAFADEKNLEELISVELDQKINLLDKLANSSKGTNIVFSAAFQQNIPLGQIYVGFAGGSASPQANANDGVSSVASDQRLHFENGSEISFDQFVNSALRGETSVKGGTDQANNHLANCAANGVKREMLVPDATFMDKL

SEQ ID NO: 170245 - protein, 94 aa, Heterodera glycines
  Coding regions on vcDNA: vcDNA=SeqID_96668; Strand=+; Position=200-481
HNYHKRPIIKTLVRKRLYWLRSPSPTFADSDHSQNNESSIESAANLHENTATEERPRAESTSQNVGADATACMTTRPSDDNESYLDEQGLRWHR

SEQ ID NO: 170246 - protein, 102 aa, Heterodera glycines; identical to SEQ ID NO: 166063
  Coding regions on vcDNA: vcDNA=SeqID_96669; Strand=+; Position=6-314

SEQ ID NO: 170247 - protein, 160 aa, Heterodera glycines
  Coding regions on vcDNA: vcDNA=SeqID_96670; Strand=+; Position=1-480
GGDAVPLPSAVADSPFLEVDLNRTLTPQSQWTNESTGTMHPIVDTEPNPIRDAHEPNHIFHYSPSSHSPDDDESSQNGQSSSSQSAPISSALDASLTNLYKEKENDECDDERSMPRRASERTLDRFEDVRTIASSDIEVIRQMDDWSVTSSYPNSSHQQS

SEQ ID NO: 170248 - protein, 136 aa, Heterodera glycines
  Homolog annotation: Hit_ID=XP_215474.2; Match level="QueryCoverage =91%, HitCoverage=19%, E-value=2e-27, Identity=42%"; Hit description =similar to RIKEN cDNA 4632422M10 [Rattus norvegicus]
  Gene Ontology: Biological process=protein folding
  Coding regions on vcDNA: vcDNA=SeqID_96671; Strand=+; Position=1-408
ILDANGDKQPIHVFESLHQHPVILMQYTAAFDVAISFDEIGMVEYWSGSRNEFSFPKTVNFEFKTDTDLYEFCKIKQMPKALAISPDGRTFAVWCSNSYIYIFDLRSGKIIKKLDETLQRYIEMGKETKGNGLPAI

SEQ ID NO: 170249 - protein, 160 aa, Heterodera glycines
  Coding regions on vcDNA: vcDNA=SeqID_96672; Strand=+; Position=1-480
LLSLSELVPLNGRGGSGGVFYKTKDDKFILKSLNPDHDEPAKIDEVLDNYSKHVLGQQPEKGKQSTDSRSMMNTFFMYFEMNVYAKLKEGKGKERKKKLRLHMLQFVVLNNVFEGIDEQTLLKFDIKGTFAPGSAVQHDQKQKWYTGETGWQKSLYREYD

SEQ ID NO: 170250 - protein, 159 aa, Heterodera glycines
  Homolog annotation: Hit_ID=EAL39955.1; Match level="QueryCoverage =84%, HitCoverage=45%, E-value=5e-09, Identity=27%"; Hit description =ENSANGP00000014227 [Anopheles gambiae str. PEST]
  Coding regions on vcDNA: vcDNA=SeqID_96673; Strand=+; Position=3-479
SSLRLGSQRSHAVNAVHPKREKPNYERPKSQQSTKTEQQKCWRCGQTNHHHAACPQKGYKCRKCSQNGHIELRCEAVQEWRKKNAKSWLKKNVGNVHIVTVNIGTTAKPTTKSTLLRVKVSFQGKVIEFVLDSGAEVNVINEMTYKLIGSPKIKACKEQ

SEQ ID NO: 170251 - protein, 140 aa, Heterodera glycines; identical to SEQ ID NO: 163101
  Coding regions on vcDNA: vcDNA=SeqID_96674; Strand=-; Position=1-420

SEQ ID NO: 170252 - protein, 113 aa, Heterodera glycines; identical to SEQ ID NO: 166047
  Homolog annotation: Hit_ID=NP_001004509.1; Match level="QueryCoverage= 100%, HitCoverage=8%, E-value=6e-11, Identity=32%"; Hit description =si:busm1-180o5.3 [Danio rerio] emb|CAD60788.1| novel protein similar to DNA polymerases [Danio rerio]
  Coding regions on vcDNA: vcDNA=SeqID_96675; Strand=-; Position=3-341

SEQ ID NO: 170253 - protein, 37 aa, Heterodera glycines; identical to SEQ ID NO: 166044
  Coding regions on vcDNA: vcDNA=SeqID_96676; Strand=+; Position=88-201

SEQ ID NO: 170254 - protein, 232 aa, Heterodera glycines
  misc_feature (148)..(148): Xaa can be any naturally occurring amino acid
  misc_feature (221)..(221): Xaa can be any naturally occurring amino acid
  Homolog annotation: Hit_ID=CAE61329.1; Match level="QueryCoverage =92%, HitCoverage=36%, E-value=6e-48, Identity=43%"; Hit description =Hypothetical protein CBG05167 [Caenorhabditis briggsae]
  Gene Ontology: Cellular component=membrane; Biological process=lipid metabolism
  Coding regions on vcDNA: vcDNA=SeqID_96677; Strand=+; Position=6-704
MPSNAQKADKTMANGKQQTIGEKQPEHKRRVMRHRHIRLKPNILNSSAAANASKKRHPQPNFDTIEVLEEEHEFEVPINEEEMMRFPGMEEGSQKSDKISVHRRFWQLNWKGVHFSGLPTWLQDNEFLHFGHRPPLPSFGSCFNSIFXLHTETGNILTHMYGAIAFIGIFIWFLVQAEDVVSWPDKLIFSSFFVGAILCMGMSFAFHTVQYHFEDINKLVXKLDYSTCAYYH

SEQ ID NO: 170255 - protein, 139 aa, Heterodera glycines
  Homolog annotation: Hit_ID=NP_740945.1; Match level="QueryCoverage =76%, HitCoverage=20%, E-value=3e-19, Identity=49%"; Hit description =DNA methyltransferase protein 1 (55.8 kD) (1P67) [Caenorhabditis elegans] emb|CAD21666.1| Hypothetical pr
  Coding regions on vcDNA: vcDNA=SeqID_96678; Strand=+; Position=59-475
MGHLLSMDSHIRWPEFKTPGPHLRSQEMKLPSNIGQKKLSNIGLVVTTRKIVSIGLEYPHAYEEIVKQYNDFRSHIVLLQDLKTALHNTELELDQLAAQMPADKECPIIEPRFRVSSTFYEELERSPVRVLNTPMTEGG

SEQ ID NO: 170256 - protein, 119 aa, Heterodera glycines
  Homolog annotation: Hit_ID=NP_508183.1; Match level="QueryCoverage =100%, HitCoverage=28%, E-value=4e-42, Identity=70%"; Hit description= ARRestin, beta 1, Drosophila kurtz homolog (48.5 kD) (arr-1) [Caenorhabditis elegans] gb|AAA82342.2| Arr
  Gene Ontology: Mol. function=protein binding; Cellular component =heterotrimeric G-protein complex; Biological process=signal transduction
  Coding regions on vcDNA: vcDNA=SeqID_96679; Strand=+; Position=2-358
TLQPAQGDTGKPCGVDYEIKTMVGGDSTQEKPKKHNSVRLAIRKLTYCPQLERIQPMVDVTKNFIISPGGLHLEASLDKEMYYHGESIAVNVHIQNNSNKTVKKIKVTVQQMADICIFT

SEQ ID NO: 170257 - protein, 54 aa, Heterodera glycines
  Coding regions on vcDNA: vcDNA=SeqID_96680; Strand=+; Position=318-479
GEGDRLAVQHRQEKEFERTIRTYKSPYISFTYFHSQTLAEEAKRNAHTLVLHFV

SEQ ID NO: 170258 - protein, 111 aa, Heterodera glycines
  Coding regions on vcDNA: vcDNA=SeqID_96681; Strand=+; Position=143-475
MNTTSSIPMGPVLPCIGQNNKKYEVMKKKKEKNDEKMTLETNKMAGEKRKRPPSLSEKSFPYNAGLERNKLFVKKLDWSCTGEELKKFFEKFGTVVDARIVTKWDGRSKGC

SEQ ID NO: 170259 - protein, 138 aa, Heterodera glycines
  misc_feature (20)..(20): Xaa can be any naturally occurring amino acid
  misc_feature (81)..(82): Xaa can be any naturally occurring amino acid
  misc_feature (87)..(87): Xaa can be any naturally occurring amino acid
  Coding regions on vcDNA: vcDNA=SeqID_96682; Strand=+; Position=41-454
ARTRTRHCDRSVSAAELEQXQQRICSSSISSHRHPLLLSFSPSPCLKRNRNIPTKRLRRKALPRMKGACRNRRPPKKRSRXXGGVIXPKNLGDLHRPGGGGAGFFTKQGGETPPGGVGGGISRDPRGGPKNLRGNFWG

SEQ ID NO: 170260 - protein, 159 aa, Heterodera glycines
  Coding regions on vcDNA: vcDNA=SeqID_96683; Strand=+; Position=3-479
LRFRKMSNLNFEDNLQRVQVEIQWKQCLYNPIVAPFADVGSYPIFTDEFKGTRKCTLDVYVQGNLEHLDDKVVSYGSSHGTFRAINSFVSRITQLRLIASISSPTQRFSSPFMTLARRICLAWTLPTVRRSLRWSVSVPFSSTFLCQGKRPALKILSES

SEQ ID NO: 170261 - protein, 211 aa, Heterodera glycines; identical to SEQ ID NO: 165858
  Homolog annotation: Hit_ID=AAL78214.1; Match level="QueryCoverage =72%, HitCoverage=75%, E-value=2e-11, Identity=27%"; Hit description =putative esophageal gland cell protein Hgg-20 [Heterodera glycines]
  Coding regions on vcDNA: vcDNA=SeqID_96684; Strand=+; Position=11-643

SEQ ID NO: 170262 - protein, 54 aa, Heterodera glycines; identical to SEQ ID NO: 163092
  Coding regions on vcDNA: vcDNA=SeqID_96685; Strand=+; Position=25-189

SEQ ID NO: 170263 - protein, 124 aa, Heterodera glycines
  Coding regions on vcDNA: vcDNA=SeqID_96686; Strand=-; Position=222-596
TVHQTFRDRDKCQEEKSALDLTVTTDQEGNYYILFLYLGVPNAEVGLQYHQTSEIRCAPRDHRQLFSGSPNITCQQFCFHFPRNGKRINSPCPWTKPSNTSMGNWKMPTKLPKLRAMDRKSGPT

SEQ ID NO: 170264 - protein, 150 aa, Heterodera glycines; identical to SEQ ID NO: 166030
  Homolog annotation: Hit_ID=NP_726651.1; Match level="QueryCoverage =75%, HitCoverage=21%, E-value=1e-38, Identity=63%"; Hit description =CG17743-PB, isoform B [Drosophila melanogaster] ref|NP_524630.1| CG17743-PA, isoform A [Drosophila melano
  Gene Ontology: Mol. function=zinc ion binding; Cellular component =transcription factor complex; Biological process=regulation of transcription from Pol II promoter
  Coding regions on vcDNA: vcDNA=SeqID_96687; Strand=-; Position=122-574

SEQ ID NO: 170265 - protein, 73 aa, Heterodera glycines
  Coding regions on vcDNA: vcDNA=SeqID_96688; Strand=-; Position=1-219
DGLTPCEGGRGPTKSFRVLAVNPKSGGCPQRKVFESLPDVFDSSCHLCPKFAFFCCLLDILRGFSLDYLKNRN

SEQ ID NO: 170266 - protein, 233 aa, Heterodera glycines; identical to SEQ ID NO: 163069
  Coding regions on vcDNA: vcDNA=SeqID_96689; Strand=+; Position=131-832

SEQ ID NO: 170267 - protein, 88 aa, Heterodera glycines; identical to SEQ ID NO: 163017
  Coding regions on vcDNA: vcDNA=SeqID_96690; Strand=+; Position=82-348

SEQ ID NO: 170268 - protein, 53 aa, Heterodera glycines
  Coding regions on vcDNA: vcDNA=SeqID_96691; Strand=-; Position=2-160
TNSTNCAIKWCPDLLRELAKKNVVAFQSWRRRNSRHRTDTVGKNVGDLGTRGP

SEQ ID NO: 170269 - protein, 152 aa, Heterodera glycines
  Homolog annotation: Hit_ID=AAH45080.1; Match level="QueryCoverage =94%, HitCoverage=46%, E-value=4e-25, Identity=42%"; Hit description =MGC53836 protein [Xenopus laevis]
  Coding regions on vcDNA: vcDNA=SeqID_96692; Strand=+; Position=509-964
RSSILPFPLQVYYSLFTSLLSVFLAKTSINGLLHRGRMFIFSHSHLKVFLAIPDDWSPIGCQLLDIGAGDGAVTAKFTSICVVEASKVMEWRLARRGFTVLPMDKWQRSGPYSLITALNLLDRHHDPKKLLNSLHELAIEHNCPILLSVVLP

SEQ ID NO: 170270 - protein, 61 aa, Heterodera glycines
  Coding regions on vcDNA: vcDNA=SeqID_96693; Strand=+; Position=151-336
FDSLKRAFPSHVLVPKMLLAQKVKGEKEDKSSDQGLSLNRSQCKSCSTANNPLTSSQVVYK

SEQ ID NO: 170271 - protein, 42 aa, Heterodera glycines
  Coding regions on vcDNA: vcDNA=SeqID_96694; Strand=+; Position=90-215
LGYQSLKKFKFESDFGHRRKCRGSLQMTFFAFETTFWSAFFS

SEQ ID NO: 170272 - protein, 188 aa, Heterodera glycines
  Coding regions on vcDNA: vcDNA=SeqID_96695; Strand=+; Position=17-583
NAFPFCASIHTAEAFSRPTIFSFSSVIGKMLSTYALFYPTIICYIFCFRIWVATASTASYRTAGPKTKVPDKNEWMKRCAAEYERKYCVETDTKLKQQTTKNKEKKKQQQQQDESPEEYYPTNYEPAFNYDKLHVSDIILPLTIHQKDKYQAQNGPTKYEPKAEGQHVTSSVTTAVLILWNCVGIDLF

SEQ ID NO: 170273 - protein, 108 aa, Heterodera glycines
  Coding regions on vcDNA: vcDNA=SeqID_96696; Strand=+; Position=157-480
NFALTNVKSSNVRPFFDSPLFLLMLLLLCLLLSVFFIAFYRPFPVLSPPPGVPFLPKHHSHTNSFSSNFPKCPKHHSQPIHSLLTFQNVPNTTATPIHSLLTFQNVTA

SEQ ID NO: 170274 - protein, 141 aa, Heterodera glycines
  Homolog annotation: Hit_ID=CAE72187.1; Match level="QueryCoverage =90%, HitCoverage=43%, E-value=1e-33, Identity=50%"; Hit description =Hypothetical protein CBG19295 [Caenorhabditis briggsae]
  Coding regions on vcDNA: vcDNA=SeqID_96697; Strand=+; Position=127-549
FHQAANASPFLPLFISLMTLPPSLFAFDQMPTLDPAIPTQSPHLAPSSDSCVGQCALIFTDQMRSQLGSEHSTGLLNLNYNEFLAAFSNSSFFDSFCNIYHQFNFCYTKCPQGFMQELLSRSAEIVDHFCVWNYKEIKTKF

SEQ ID NO: 170275 - protein, 56 aa, Heterodera glycines
  Coding regions on vcDNA: vcDNA=SeqID_96698; Strand=-; Position=1-168
IFLEFFAWRNTVLHTYHTSIIFFKLFFAFDPQRSRLIESSPNFAGKLLRTLQMLIN

SEQ ID NO: 170276 - protein, 81 aa, Heterodera glycines; identical to SEQ ID NO: 166002
  Coding regions on vcDNA: vcDNA=SeqID_96699; Strand=-; Position=2-244

SEQ ID NO: 170277 - protein, 59 aa, Heterodera glycines
  Coding regions on vcDNA: vcDNA=SeqID_96700; Strand=-; Position=3-179
ASVAWWLCLPYFFLLLKFNSLNPVNNYFVFFFISKLVFKLFNINKFEHNIFFIFILYER

SEQ ID NO: 170278 - protein, 117 aa, Heterodera glycines
  Coding regions on vcDNA: vcDNA=SeqID_96701; Strand=+; Position=65-418
QDGIPPNECLFCELKSDTWEANLAHMRKQHGFLVPDSPFCTECARVAHLFGCGTLLFQFLFLITFQGFKVGDGLTCVRCQCARFRSIDGLLKHMRRLQPLQLSNLFTTGGACCSLCK

SEQ ID NO: 170279 - protein, 58 aa, Heterodera glycines
  Coding regions on vcDNA: vcDNA=SeqID_96702; Strand=+; Position=1-177
GNSADSTPQQYAYPNGINSTGTVTKGAGDGTVNIDSLRVCQQWKDQGKLVGGKSRTLN

SEQ ID NO: 170280 - protein, 144 aa, Heterodera glycines
  Homolog annotation: Hit_ID=CAB59856.1; Match level="QueryCoverage =95%, HitCoverage=40%, E-value=7e-46, Identity=67%"; Hit description =THI2p [Uromyces viciae-fabae] sp|Q9UVF8|THI4_UROFA Thiazole biosynthetic enzyme, mitochondrial precursor
  Gene Ontology: Cellular component=mitochondrion; Biological process =DNA repair
  Coding regions on vcDNA: vcDNA=SeqID_96703; Strand=+; Position=58-489
MFKQLNEAEVARAMISRYWRDLYERAECDVVIVGAGSAGLSCAYCLATRHPHLSIAIIEANVAPGGGAWLGGQLMSAMVVDKEMEPFLDELAVPYEEGGPNFVVVPHAALFTATLLAKVLAQPNVKLFNATAVEDLIIKRQQQS

SEQ ID NO: 170281 - protein, 82 aa, Heterodera glycines
  Coding regions on vcDNA: vcDNA=SeqID_96704; Strand=-; Position=2-247
GFWRLFGHPLDFLKFSPSVDSSSNSVSVLIDALLHGLSSNAAKQSLNKLFAADQQQLMDEVHRNGPESVLDKIGGHVSVESN

SEQ ID NO: 170282 - protein, 170 aa, Heterodera glycines
  Homolog annotation: Hit_ID=CAE56710.1; Match level="QueryCoverage =88%, HitCoverage=35%, E-value=4e-43, Identity=56%"; Hit description =Hypothetical protein CBG24496 [Caenorhabditis briggsae]
  Gene Ontology: Mol. function=protein binding; Cellular component =membrane; Biological process=muscle contraction
  Coding regions on vcDNA: vcDNA=SeqID_96705; Strand=+; Position=45-645
MQFRNFRSLQLKNIKYLPFSKIFPGMSADKTGALFVGDIILAVNGESLVNARHDEAVRALKQAGKMVNLQVQYRRDLHLRRENMLHRLSWEESRVEALRSFGLKLAFVTRNPIEEEDPENRTIEIRSHSARHILTLRCSSATEADAWFEAIHSCADTLLTQALAQVNLIL

SEQ ID NO: 170283 - protein, 208 aa, Heterodera glycines
  Homolog annotation: Hit_ID=NP_500306.1; Match level="QueryCoverage =88%, HitCoverage=28%, E-value=1e-70, Identity=70%"; Hit description =acetolactate synthase homolog (69.3 kD) (4E27) [Caenorhabditis elegans] gb|AAC17553.2| Hypothetical prote
  Gene Ontology: Biological process=embryogenesis and morphogenesis
  Coding regions on vcDNA: vcDNA=SeqID_96706; Strand=+; Position=2-625
SPVPKCPVISGRKFFSSDAFNVDRNCTRHGGELVANVLKAHDVREVFTLCGGHISPILVACEQLGINIFDTRHEVNAVFAADAVSRLRQNIGVAAVTSGPGVTNTITALKNAQMAESPVILLSGAAPTLMKGRGALQDIDQLSIVKSMCKFTANVQNVGDIVPTLREAIAAARSDTPGPAFVELPLDVLQPYGKVLAETNFVVHADTA

SEQ ID NO: 170284 - protein, 96 aa, Heterodera glycines; identical to SEQ ID NO: 165959
  Coding regions on vcDNA: vcDNA=SeqID_96707; Strand=-; Position=1-288

SEQ ID NO: 170285 - protein, 162 aa, Heterodera glycines
  Coding regions on vcDNA: vcDNA=SeqID_96708; Strand=-; Position=3-488
GHIEPGSTFTLTMPNWGFDPFPLLRLLSTGQWLLIAVASEIIALAALFVFIKFNPHFRLYRSLAALAFVALIGKGEAVGTGFNSRLITNSDISSIHPTISSLRPTFSPKFSHFFTSLIYSKIVGPKTTGQQQKTAFPFINNSDLDKNLCPSNKRRATGDVYP

SEQ ID NO: 170286 - protein, 288 aa, Heterodera glycines; identical to SEQ ID NO: 163070
  Homolog annotation: Hit_ID=NP_741220.1; Match level="QueryCoverage =99%, HitCoverage=43%, E-value=2e-83, Identity=54%"; Hit description =heat shock protein 75 (3I314) [Caenorhabditis elegans] gb|AAK29856.2| Hypothetical protein R151.7a [Caeno
  Gene Ontology: Mol. function=tumor necrosis factor receptor binding; Cellular component=extracellular space
  Coding regions on vcDNA: vcDNA=SeqID_96709; Strand=+; Position=3-866

SEQ ID NO: 170287 - protein, 58 aa, Heterodera glycines; identical to SEQ ID NO: 165950
  Coding regions on vcDNA: vcDNA=SeqID_96710; Strand=-; Position=3-176

SEQ ID NO: 170288 - protein, 61 aa, Heterodera glycines
  Coding regions on vcDNA: vcDNA=SeqID_96711; Strand=-; Position=44-229
ILPNFNFSYVLKKLLCTILHYFLYESRSIFCHFFHLSFFHFLTFFSFSLSFYFNSKIFYLK

SEQ ID NO: 170289 - protein, 57 aa, Heterodera glycines
  Coding regions on vcDNA: vcDNA=SeqID_96712; Strand=-; Position=62-235
MDMNLTNGGDVVSVQQRQNGGVGPTSLSSFNSFRQPVPPPPPPQNRLSLNGTMLHRV

SEQ ID NO: 170290 - protein, 110 aa, Heterodera glycines
  Coding regions on vcDNA: vcDNA=SeqID_96713; Strand=+; Position=221-550
RKRGIEYRKKRGIEYRNDSFIILWKLLLVRGINSNILKSGSNNNNNNGKRRNFRHYVRALDTDVAFNKKFRLMNAKSTFMIQTLPSNPESLLRVIFGHCIQSSLDEAQRR

SEQ ID NO: 170291 - protein, 92 aa, Heterodera glycines
  Coding regions on vcDNA: vcDNA=SeqID_96714; Strand=-; Position=4-282
QSLICVCIVFKKTSLLPFFRLSVRQISAFVMRRSPINGKSTVHEKGRKSLIALHLGGVGRWCSSPLRRFRRFASSCFRSCFSCFFRSKYSWN

SEQ ID NO: 170292 - protein, 102 aa, Heterodera glycines
  misc_feature (26)..(26): Xaa can be any naturally occurring amino acid
  Homolog annotation: Hit_ID=AAL78227.1; Match level="QueryCoverage =85%, HitCoverage=34%, E-value=1e-42, Identity=94%"; Hit description =hypothetical protein Hgg-18 [Heterodera glycines]
  Coding regions on vcDNA: vcDNA=SeqID_96715; Strand=+; Position=1-309
FKLVDPPGCSDSARGKGQRRVDFDNXRQKDDFGREGEADGGADSQNVGQHEEGAESEQQCRRRRLRQVVLRRRRAGGGHGGQSMINQSDRRIRHCCVMKCSQ

SEQ ID NO: 170293 - protein, 130 aa, Heterodera glycines
  Coding regions on vcDNA: vcDNA=SeqID_96716; Strand=+; Position=3-392
DNASKKSTSDYPYTALSDQLAAISQQMDNNSVDPITKQLLKICVELLQQVQQQQTVISEQDLQLQHFKQQKMMEEAIQDHERRRSVVVMGLPESHKQKPSERVAEDRTAISCVLDELGIESPITVYRMGS

SEQ ID NO: 170294 - protein, 55 aa, Heterodera glycines
  Homolog annotation: Hit_ID=EAL20618.1; Match level="QueryCoverage =100%, HitCoverage=28%, E-value=3e-11, Identity=54%"; Hit description= hypothetical protein CNBE3260 [Cryptococcus neoformans var. neoformans B-3501A]
  Gene Ontology: Mol. function=transcription factor activity; Cellular component=CCAAT-binding factor complex; Biological process =regulation of carbohydrate metabolism
  Coding regions on vcDNA: vcDNA=SeqID_96717; Strand=+; Position=2-166
QDRLLPIANISRIMRRDLPTERKLSKHNTKCVQECITEFVLLITSQVSERCSLQK

SEQ ID NO: 170295 - protein, 149 aa, Heterodera glycines
  Homolog annotation: Hit_ID=CAE73007.1; Match level="QueryCoverage =85%, HitCoverage=19%, E-value=6e-51, Identity=75%"; Hit description =Hypothetical protein CBG20362 [Caenorhabditis briggsae]
  Gene Ontology: Mol. function=calmodulin-dependent cyclic-nucleotide phosphodiesterase activity; Biological process=apoptosis
  Coding regions on vcDNA: vcDNA=SeqID_96718; Strand=+; Position=65-511
MMIIGDQYGFYQLVLRKHACRLRYILHQLNGGQLSLEDLKRNIEYAALVLETAYMDETRRICDEDDDLAEVTPEAVPDEVREWLTATFTRQTVQSRKEKPKFKSVANAIRTGIFFEKIYRRTQSVLAPIPHEYLPFLRQVNNWNFDSFD

SEQ ID NO: 170296 - protein, 156 aa, Heterodera glycines
  Homolog annotation: Hit_ID=CAE70885.1; Match level="QueryCoverage =94%, HitCoverage=84%, E-value=2e-35, Identity=57%"; Hit description =Hypothetical protein CBG17675 [Caenorhabditis briggsae]
  Gene Ontology: Mol. function=pre-mRNA splicing factor activity; Cellular component=nuclear speck; Biological process=spliceosome assembly
  Coding regions on vcDNA: vcDNA=SeqID_96719; Strand=+; Position=41-508
MSSRRNEYLDAKIYVGGLPEDATSEELDDAFHRFGRIRKIWVARRPPGFAFVEFEDARDAEDAVRALDGTRICGVKARVELSHGNGRGGGRGFQGKRGRCDDRYGRDRYDRDRDRRYRSSFSSSPSHLVALLLNSPLNSIFQSQPSHNAIHPISSH

SEQ ID NO: 170297 - protein, 69 aa, Heterodera glycines; identical to SEQ ID NO: 165920
  Homolog annotation: Hit_ID=NP_501141.1; Match level="QueryCoverage =98%, HitCoverage=6%, E-value=4e-18, Identity=62%"; Hit description =solute carrier family 12 member (4H981) [Caenorhabditis elegans] gb|AAA81476.1| Temporarily assigned gene
  Gene Ontology: Mol. function=potassium:chloride symporter activity; Cellular component=mitochondrion; Biological process=embryogenesis and morphogenesis
  Coding regions on vcDNA: vcDNA=SeqID_96720; Strand=+; Position=2-211

SEQ ID NO: 170298 - protein, 179 aa, Heterodera glycines
  misc_feature (85)..(85): Xaa can be any naturally occurring amino acid
  misc_feature (101)..(101): Xaa can be any naturally occurring amino acid
  Homolog annotation: Hit_ID=CAB88203.1; Match level="QueryCoverage =100%, HitCoverage=97%, E-value=2e-71, Identity=52%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Coding regions on vcDNA: vcDNA=SeqID_96721; Strand=+; Position=19-554
MQETHIVLGIASVCSLLAIIATVVTLPSLYSEMSQMNSKVRDGVEAFRVNTDSAWTDLMDVQVVVTPPSKPRDNPFNSIFRAKRXQLPGHCQCAGLQQPSXPPGPPGPSGPPGQPGQPGGAGQPGQPGQPGQPAPPGAPGQPGQPGNSGQPGQPGAPGQPGKDSGYCPCPPRSSVLAVK

SEQ ID NO: 170299 - protein, 158 aa, Heterodera glycines
  Coding regions on vcDNA: vcDNA=SeqID_96722; Strand=+; Position=3-476
LINLPTSPGPSFADRNANNEPRNCRNKPMETMKASSSSLCYKNSCFLSDLLSSTNRRGNLRLLESEPFADEAATEAETELLLFAELEQQMDEDGNKQKYPDEEMPCHSASSSAFSADNCHAQLPIFCGVCFAECAAFDSFALRRCEPFGATHTFCDDC

SEQ ID NO: 170300 - protein, 171 aa, Heterodera glycines
  Coding regions on vcDNA: vcDNA=SeqID_96723; Strand=+; Position=38-550
WIPRAACQDERINGICPPGALLIIIKDVTEEKYLINLPTSLGPSFADRNANNEPRNCRNKPMETMKASSSSLCYKNSCFLSDLLSNASRRGNLRLLESEPFANEAATDAEAERLLFAELEQQMDEDGNQQKHPDEQMPCYSASSSAFSADNYPTQLPIFCGVCFAECAAFD

SEQ ID NO: 170301 - protein, 129 aa, Heterodera glycines
  Coding regions on vcDNA: vcDNA=SeqID_96724; Strand=+; Position=94-480
MVRMADVSQDDILVVEGAIDNDQTLKNLVERTYNKFGQIDVLVNNAGSILQHQRSRQNSNSNNSTSSNNYGYDYTNGQNGAEEEDGGRGRYHGFRGFRRTSSSATAMTSRRTCSIFGALDNDFDFLFNI

SEQ ID NO: 170302 - protein, 170 aa, Heterodera glycines
  misc_feature (27)..(27): Xaa can be any naturally occurring amino acid
  Homolog annotation: Hit_ID=XP_396184.1; Match level="QueryCoverage =91%, HitCoverage=29%, E-value=2e-24, Identity=37%"; Hit description =similar to phosphatidylinositol polyphosphate 5-phosphotase isoform b [Apis mellifera]
  Gene Ontology: Mol. function=phosphatidylinositol-bisphosphatase activity; Cellular component=Golgi vesicle; Biological process=lipid metabolism
  Coding regions on vcDNA: vcDNA=SeqID_96725; Strand=+; Position=3-517
RIGTPSDHKPVLSTFRVQVKKVDRHEXAQFMSSCCREVDKRQNELLPQITLSNTEFHFSTVLFDQPSLGVLTITNTGQTPTHFSFKPARPEADRLEEWLTITPLSSFIDVGGAVEVTLQILVFDESACKVPKDGAELSSIIIVHLTGGRDYFIVVDAKYQREVKDLISFN

SEQ ID NO: 170303 - protein, 118 aa, Heterodera glycines
  Coding regions on vcDNA: vcDNA=SeqID_96726; Strand=+; Position=237-590
MCEWLMQSEGDDDWSDEEGTAAGPIEPCARFFASASQMVFHVYNEHLVPLVQQHSDGEPPRIRCRWPICDNTPRTLWSITTHLQDIHCTENALESAMLQRVEMGYHEYVYHIRQQFER

SEQ ID NO: 170304 - protein, 148 aa, Heterodera glycines
  Coding regions on vcDNA: vcDNA=SeqID_96727; Strand=+; Position=4-450
EMASVTDRFLMNWKGIPLGFGLVTSTTFHIFNNRWLRNRFNANAFESKETKIAEQMLQQRRRNELMLHFKMASYGAPVALGTLAAGGILSSLPKILRLPNSIGFTVCGFGLSIGAFIVGALLLDGPMYAYTEWVQQRTDKGTEKQKVE

SEQ ID NO: 170305 - protein, 101 aa, Heterodera glycines; identical to SEQ ID NO: 165910
  Coding regions on vcDNA: vcDNA=SeqID_96728; Strand=-; Position=1-303

SEQ ID NO: 170306 - protein, 324 aa, Heterodera glycines; identical to SEQ ID NO: 163052
  Homolog annotation: Hit_ID=NP_505605.1; Match level="QueryCoverage =99%, HitCoverage=40%, E-value=3e-34, Identity=32%"; Hit description =WD repeat domain 20 (5K612) [Caenorhabditis elegans] emb|CAA96589.1| Hypothetical protein C08B6.7 [Caenor
  Gene Ontology: Biological process=meiosis
  Coding regions on vcDNA: vcDNA=SeqID_96729; Strand=+; Position=1-972

SEQ ID NO: 170307 - protein, 52 aa, Heterodera glycines
  misc_feature (11)..(11): Xaa can be any naturally occurring amino acid
  Coding regions on vcDNA: vcDNA=SeqID_96730; Strand=-; Position=144-302
LASPPFTHRPXHPLITPPQLTPQLPSPSMSRPIFGHMSDDAFLFIYLCAPLA

SEQ ID NO: 170308 - protein, 161 aa, Heterodera glycines
  Coding regions on vcDNA: vcDNA=SeqID_96731; Strand=+; Position=1-486
GSSNFVILQLIKAADQLYYKDKTLYTAIKPELIRSDTNRPKDAEKHQQIQKSGKKTADDNSGKKAAENLKQNNVQQAKNGESKRSKLQEMIGQAKKTVENALGSSHGSLESHQNSIDLRQEVAEINSKCADLANLLNALEQRLRAVEELTEGIAKKIGYSS

SEQ ID NO: 170309 - protein, 132 aa, Heterodera glycines
  Homolog annotation: Hit_ID=XP_346534.1; Match level="QueryCoverage =100%, HitCoverage=14%, E-value=2e-32, Identity=52%"; Hit description= hypothetical protein XP_346533 [Rattus norvegicus]
  Gene Ontology: Mol. function=DNA ligase activity; Cellular component =nucleus; Biological process=DNA replication
  Coding regions on vcDNA: vcDNA=SeqID_96732; Strand=+; Position=3-398
KIGTGFKDEDLKSQFKEFQELRIDKPRSYFAFDPSLAPDHWFEPSVVWEVKAADMSISPRHLAARGLVDAEKGHSSSFPDTKNSFLGISLRFPRFIRNRADKKPENATSSEQIAEMYRNQDHIKNQKDGKVD

SEQ ID NO: 170310 - protein, 39 aa, Heterodera glycines
  Coding regions on vcDNA: vcDNA=SeqID_96733; Strand=+; Position=43-159
TFVSIKMPLFHSFFLILLFLNLFFQFIFLKALKVPRFLV

SEQ ID NO: 170311 - protein, 150 aa, Heterodera glycines
  Homolog annotation: Hit_ID=CAE73340.1; Match level="QueryCoverage =84%, HitCoverage=86%, E-value=6e-19, Identity=36%"; Hit description =Hypothetical protein CBG20771 [Caenorhabditis briggsae]
  Coding regions on vcDNA: vcDNA=SeqID_96734; Strand=+; Position=26-475
MAAKELFLAQQPDLFKPIQSINAVLILICLGSSTAVPGIGVLWFIGLCSLIVSVTATEFVYSSVLTLLCGVGFWLSFGFASHVPDNGHSAGYIFAGIFLVAQVACYAIPVLIIYDRSRTDGPAAAGHEQIANVHPFGVTTDGCEQHYQSM

SEQ ID NO: 170312 - protein, 163 aa, Heterodera glycines
  Coding regions on vcDNA: vcDNA=SeqID_96735; Strand=+; Position=1-489
QVLPQFVPPFLLLILLSSACPFSLAFSSDILPSVTNSTGIGNGTDATTDPTDTTGNSDLMTSATLPEETTAKEEEGTKPGTDGTARDGQGTGEPQKDGEGLKQDTGVSAADGNGTAEPPKEGDESPQESFACSVLCWTLIIVGGVFICAVGLTAFVLLTVHYQ

SEQ ID NO: 170313 - protein, 109 aa, Heterodera glycines
  Homolog annotation: Hit_ID=NP_496203.2; Match level="QueryCoverage =100%, HitCoverage=20%, E-value=1e-20, Identity=44%"; Hit description= leucine-rich repeat containing protein (2K499) [Caenorhabditis elegans] emb|CAA88748.2| Hypothetical pro
  Coding regions on vcDNA: vcDNA=SeqID_96736; Strand=+; Position=154-480
MVRSLFDICLASVCQRSLVFDADLSLLPCDCKQRLMEFFASHDQLNSELCFGLMSRPMFGRNLTRLCFYLSDQLNDSILEALASFNQNLRIISIVECPRVTDTGIVSVT

SEQ ID NO: 170314 - protein, 158 aa, Heterodera glycines
  Homolog annotation: Hit_ID=NP_510509.2; Match level="QueryCoverage =99%, HitCoverage=27%, E-value=5e-53, Identity=62%"; Hit description =laminin A (XP714) [Caenorhabditis elegans] emb|CAB05478.2| Hypothetical protein F09B12.3 [Caenorhabditis
  Coding regions on vcDNA: vcDNA=SeqID_96737; Strand=+; Position=2-475
NKFKPYTELPDHGLFYVLEQMPTIVLYQDMTQWLKQNGYFASYNIPFFKKTSLISGFEQKGNEFYWFSWKSCPRAKIFARDQHKVVDLDSLTKLMRYNDYTRDPYSRCNCTPPYTAEAAISARGDLNPANGTFEIPGMGHVNHAALDYKGTGYKMFKK

SEQ ID NO: 170315 - protein, 155 aa, Heterodera glycines
  Coding regions on vcDNA: vcDNA=SeqID_96738; Strand=-; Position=1-465
QYSQWNCTGLRCRPTSKFVKTQSHRAVHLLTQQHVAAPVAAQRRVVAALLAAVVVATDAAAVGPVCQQSPGSRSATGATMMTTFVHDGTRKGGSSSSYEWSKMESKNDESRHHGIRPHRCSHTSLWSFCAAVGHQCRCTRRWPCPRRLFCRTILA

SEQ ID NO: 170316 - protein, 186 aa, Heterodera glycines
  Homolog annotation: Hit_ID=NP_510298.1; Match level="QueryCoverage =95%, HitCoverage=62%, E-value=1e-50, Identity=57%"; Hit description =5'-amp-activated protein kinase (30.2 kD) (XO377) [Caenorhabditis elegans] emb|CAB04480.1| Hypothetical p
  Gene Ontology: Mol. function=SNF1A/AMP-activated protein kinase activity; Cellular component=nucleus; Biological process=signal transduction
  Coding regions on vcDNA: vcDNA=SeqID_96739; Strand=+; Position=2-559
TIQILSSSSSSTGSHQTPLQGQISSSTDDGCPVQMKIAKPDLMAEDSLEFAHNEYPVVFKWHSDAQPAKHVYLTGSWDNWRKKIPLVKSTHDFSTIINLNPGRYEYKFLVDGKWMVDDTIAKTDNQMGSQNNVMSIDEADFAVFDALDKDLASSNAGEAMRSMNSTGAQPSQDTPNDRELERLREF

SEQ ID NO: 170317 - protein, 59 aa, Heterodera glycines; identical to SEQ ID NO: 165887
  Coding regions on vcDNA: vcDNA=SeqID_96740; Strand=+; Position=1-180

SEQ ID NO: 170318 - protein, 92 aa, Heterodera glycines
  Coding regions on vcDNA: vcDNA=SeqID_96741; Strand=-; Position=65-343
KLGQKVFSEIGLKKRRMGRIKFGELPEKRSARGKSPENRNYVKLAEKATNWWISHAKCHRQNPALFTKPFTCATLGLLYSVTNRRFSSNIKA

SEQ ID NO: 170319 - protein, 169 aa, Heterodera glycines
  Homolog annotation: Hit_ID=CAE61890.1; Match level="QueryCoverage =83%, HitCoverage=44%, E-value=2e-15, Identity=36%"; Hit description =Hypothetical protein CBG05881 [Caenorhabditis briggsae]
  Coding regions on vcDNA: vcDNA=SeqID_96742; Strand=+; Position=120-629
YGRISKLYVECFNEREKCLTVIGGGKMATALVHGLVSAGFIDKSEVNICSRSKETAFRWTTQGYQNAYTNDEFYSKVKKPRGIVIVAVKPQIFPGFLDELRKNGWLNFVGPEVLCVSIMAGIALDTFKQQLKLVGFNGHAARFMPNVNCLVSAGIVLVCADDCVPTEMV

SEQ ID NO: 170320 - protein, 215 aa, Heterodera glycines
  Homolog annotation: Hit_ID=NP_505775.2; Match level="QueryCoverage =93%, HitCoverage=37%, E-value=2e-24, Identity=32%"; Hit description =putative protein, with at least 3 transmembrane domains, of eukaryotic origin (5L370) [Caenorhabditis ele
  Gene Ontology: Biological process=regulation of protein activity, epigenetic
  Coding regions on vcDNA: vcDNA=SeqID_96743; Strand=+; Position=4-648
MPTGSRVPLIVERRSDETEEDTWTVYPTAGICIKFKEAHFSAASSVSGPSTSKFFINLAHCTELPPPHRHAELDEDKVAQMVEEDPDAFRIPICVGELDRSAEDRSGEAVAKVDVLVNSEFFHKRISQSEFFRQLTLRIVFQAIEIKHSLRVDIGKQVILRNKKCIGELCAQRIRKRPMTTKEANGEGKVKETTDTKEEEDEEERTEVDQMLDIE

SEQ ID NO: 170321 - protein, 96 aa, Heterodera glycines; identical to SEQ ID NO: 163039
  Coding regions on vcDNA: vcDNA=SeqID_96744; Strand=+; Position=36-326

SEQ ID NO: 170322 - protein, 153 aa, Heterodera glycines
  Coding regions on vcDNA: vcDNA=SeqID_96745; Strand=+; Position=1-459
VIKMLRLRCPSRHFASSAASAMKARPTVEPVQQKISRLPTGFSVSSVELQIAKRTAEMQTLTTANCSSSFAADQACQLLAKGTALLSPHFQIGNITNKRTPQIVNSRWLTKEAALIGVNIEHDLLLDYAGPISQLMFAFRSGARFQQHDEAGL

SEQ ID NO: 170323 - protein, 140 aa, Heterodera glycines
  Coding regions on vcDNA: vcDNA=SeqID_96746; Strand=+; Position=161-580
MTYKEKPVINAETTENLEQERGHITRILSRMEVELDAWAAIMNGLQGPAREAEEALFTAFIRDDRHLTEWLEDAREMLAHIAAELADEPNQPIAAGGQQPAVAVNPPVPAVPFVNNAAFLGGANVQQPAAVANHANQPPL

SEQ ID NO: 170324 - protein, 60 aa, Heterodera glycines; identical to SEQ ID NO: 165870
  Coding regions on vcDNA: vcDNA=SeqID_96747; Strand=+; Position=401-580

SEQ ID NO: 170325 - protein, 156 aa, Heterodera glycines
  Coding regions on vcDNA: vcDNA=SeqID_96748; Strand=+; Position=18-485
ILLMDKENKKRKGTKRSKNPEETSKQREENQNKENDDEFIHPPRRRSARLIAISKPALSSDLSASAEDFVHGKGTKTAKSEVFGTDALFGVSSASFTSPFNSYLTSSVEPIKLSSDEATVSSNRSLTKRLNATNIQNAQSLGEGTSKATLPLSSDD

SEQ ID NO: 170326 - protein, 153 aa, Heterodera glycines; identical to SEQ ID NO: 164440
  Homolog annotation: Hit_ID=CAE62553.1; Match level="QueryCoverage =95%, HitCoverage=32%, E-value=5e-24, Identity=45%"; Hit description =Hypothetical protein CBG06663 [Caenorhabditis briggsae]
  Coding regions on vcDNA: vcDNA=SeqID_96749; Strand=-; Position=126-587

SEQ ID NO: 170327 - protein, 93 aa, Heterodera glycines
  Coding regions on vcDNA: vcDNA=SeqID_96750; Strand=+; Position=1-279
DSCAKQMVKTTKLSHLKKSRKRLKPLTGQATSSLASSSSTISTTSAHKQPFDCVDEARASGTLPTHSGRTLLRIDEDGNCVEIPMQRKPTSPV

SEQ ID NO: 170328 - protein, 50 aa, Heterodera glycines
  Coding regions on vcDNA: vcDNA=SeqID_96751; Strand=-; Position=3-152
PCQNRPDPWKTKDWPGAKQGSLSREVYGIGKSEEGIFREFPREIKIKLTE

SEQ ID NO: 170329 - protein, 55 aa, Heterodera glycines; identical to SEQ ID NO: 163032
  Coding regions on vcDNA: vcDNA=SeqID_96752; Strand=-; Position=426-593

SEQ ID NO: 170330 - protein, 62 aa, Heterodera glycines
  Homolog annotation: Hit_ID=NP_503721.1; Match level="QueryCoverage =93%, HitCoverage=11%, E-value=2e-10, Identity=55%"; Hit description =transposase family member (5D107) [Caenorhabditis elegans] ref|NP _503720.1| transposase family member (5D
  Coding regions on vcDNA: vcDNA=SeqID_96753; Strand=-; Position=3-188
KRLIFSYTHVYAADETAVWLDPGGGTCVAEKGSKTVTVLNTGHEKARVTVLLTARSDGTKMR

SEQ ID NO: 170331 - protein, 210 aa, Heterodera glycines
  misc_feature (84)..(84): Xaa can be any naturally occurring amino acid
  misc_feature (124)..(124): Xaa can be any naturally occurring amino acid
  misc_feature (165)..(165): Xaa can be any naturally occurring amino acid
  misc_feature (176)..(176): Xaa can be any naturally occurring amino acid
  Homolog annotation: Hit_ID=CAC33829.1; Match level="QueryCoverage =90%, HitCoverage=57%, E-value=6e-45, Identity=51%"; Hit description =annexin 2 [Globodera pallida]
  Gene Ontology: Mol. function=anticoagulant activity; Cellular component=plasma membrane; Biological process=skeletal development
  Coding regions on vcDNA: vcDNA=SeqID_96754; Strand=+; Position=2-631
TPTIVNNVSLDPQVSANFLHTAIEEKREDEIIHLVGPISNQDRLELARQFEPLFGEDVSSKLKNALSGDSNELILALLEPTSVXYAHPMHRAMCGLRTLKGSGLIEMLLSPRKRPVDEMTRACXTLYRHPLEKDIFGDSCGAFPPLLPSVCNYTRDKRWSSDPIXANMTARALVKXNQVESGGNESLFNQWWGTKFHSVAFDFEEIPRAA

SEQ ID NO: 170332 - protein, 200 aa, Heterodera glycines
  Homolog annotation: Hit_ID=NP_500284.2; Match level="QueryCoverage =93%, HitCoverage=6%, E-value=7e-14, Identity=27%"; Hit description =ubiquitin-associated domain and HECT domain containing protein (4D798) [Caenorhabditis elegans] gb|AAG2337
  Coding regions on vcDNA: vcDNA=SeqID_96755; Strand=+; Position=111-710
MTTAVSNTNAQQPNDATVPEGVDPAFLAALPEDMRQEVIRDHLLQQQISQADNTTARVDADVPPVERIAAIMGMEIPEGMDPAFLAALPDDIFHEVVRDHQRQQELARQRRAQIQAQQQEANHAMVRHPHIHHRHFAMPRFLSRSIRPHTHRELPSTSAAAATSSVERTVPLLDKESISTLLVLFLLDQEKFDTVRLQKL

SEQ ID NO: 170333 - protein, 148 aa, Heterodera glycines
  Homolog annotation: Hit_ID=AAB96364.1; Match level="QueryCoverage =97%, HitCoverage=39%, E-value=1e-44, Identity=65%"; Hit description =L-glycerol-3-phosphate [Takifugu rubripes] sp|O57656|GPDA_FUGRU GLYCEROL-3-PHOSPHATE DEHYDROGENASE [NAD+],
  Gene Ontology: Mol. function=glycerol-3-phosphate dehydrogenase (NAD+) activity; Cellular component=cytoplasm; Biological process =nucleotide-sugar metabolism
  Coding regions on vcDNA: vcDNA=SeqID_96756; Strand=+; Position=36-479
MTKKQVTIVGSGNWGTAIARIVGKTVQMHNSEFDDSAVKMWVFEEVVEGRKLSEIINEKHENVKYLPGKKLPTNVIAVTDVVEASKNADVLIFIIPHQFLHKVCEQLKGNIKKSAIAISLIKGLATFHEKDIGLRLISNEIATSLGID

SEQ ID NO: 170334 - protein, 191 aa, Heterodera glycines; identical to SEQ ID NO: 162208
  Homolog annotation: Hit_ID=CAE71449.1; Match level="QueryCoverage =96%, HitCoverage=47%, E-value=3e-75, Identity=75%"; Hit description =Hypothetical protein CBG18361 [Caenorhabditis briggsae]
  Gene Ontology: Biological process=tyrosine catabolism
  Coding regions on vcDNA: vcDNA=SeqID_96757; Strand=+; Position=3-578

SEQ ID NO: 170335 - protein, 130 aa, Heterodera glycines; identical to SEQ ID NO: 162209
  Homolog annotation: Hit_ID=NP_491611.1; Match level="QueryCoverage =84%, HitCoverage=43%, E-value=4e-18, Identity=40%"; Hit description =putative secreted or extracellular protein precursor of bilaterial origin (1G59) [Caenorhabditis elegans]
  Coding regions on vcDNA: vcDNA=SeqID_96758; Strand=+; Position=31-423

SEQ ID NO: 170336 - protein, 197 aa, Heterodera glycines; identical to SEQ ID NO: 162216
  Homolog annotation: Hit_ID=CAE59026.1; Match level="QueryCoverage =98%, HitCoverage=23%, E-value=1e-42, Identity=45%"; Hit description =Hypothetical protein CBG02303 [Caenorhabditis briggsae]
  Gene Ontology: Cellular component=Golgi apparatus
  Coding regions on vcDNA: vcDNA=SeqID_96759; Strand=+; Position=40-630

SEQ ID NO: 170337 - protein, 176 aa, Heterodera glycines
  Coding regions on vcDNA: vcDNA=SeqID_96760; Strand=+; Position=1-528
NESLKNVCCTFRRCSPSPLRFGISSQRRRCFCLLRATLLFAEQRIRRHFWKKNRCAIIANGCQRMGGTAKNGNGKRGRGRDGGGTAAGGSRSDGGEWGGKSEGRADGEGKSNESTNDSPPYTSPFIRRLWKWPNGATIQTNEAVLLLSNPMSDEAIFGLTRPNNAKQRDHSQNTQL

SEQ ID NO: 170338 - protein, 101 aa, Heterodera glycines
  misc_feature (54)..(54): Xaa can be any naturally occurring amino acid
  misc_feature (69)..(69): Xaa can be any naturally occurring amino acid
  misc_feature (86)..(86): Xaa can be any naturally occurring amino acid
  Homolog annotation: Hit_ID=CAG06679.1; Match level="QueryCoverage =79%, HitCoverage=11%, E-value=1e-12, Identity=53%"; Hit description =unnamed protein product [Tetraodon nigroviridis]
  Coding regions on vcDNA: vcDNA=SeqID_96761; Strand=+; Position=414-716
SGGESEGDGDWGEKCGHVCVGDGEEEGESGEEEWSRERRRERGGAESGERWREXERERERWRVESEREXEKEWMEERRERWGRERXERERESEREKSERER

SEQ ID NO: 170339 - protein, 84 aa, Heterodera glycines; identical to SEQ ID NO: 156507
  Coding regions on vcDNA: vcDNA=SeqID_96762; Strand=+; Position=84-335

SEQ ID NO: 170340 - protein, 104 aa, Heterodera glycines; identical to SEQ ID NO: 149575
  Coding regions on vcDNA: vcDNA=SeqID_96763; Strand=+; Position=5-319

SEQ ID NO: 170341 - protein, 106 aa, Heterodera glycines
  Coding regions on vcDNA: vcDNA=SeqID_96764; Strand=-; Position=2-319
FLTINFITIASIIIYHCHYHLSPLISALVLTFFFFLYASSVTSSCCCCCCFGACGWSHAYGSSGFGALFTLCVSVSERFASTQRLVAMVNSVLQFLVAAVTFAFVH

SEQ ID NO: 170342 - protein, 96 aa, Heterodera glycines; identical to SEQ ID NO: 168446
  misc_feature (92)..(92): Xaa can be any naturally occurring amino acid
  Homolog annotation: Hit_ID=NP_741519.1; Match level="QueryCoverage =98%, HitCoverage=21%, E-value=2e-24, Identity=55%"; Hit description =putative N-myristoylated protein of bilaterial origin (50.4 kD) (5E179) [Caenorhabditis elegans] gb|AAL65
  Coding regions on vcDNA: vcDNA=SeqID_96765; Strand=+; Position=1-291

SEQ ID NO: 170343 - protein, 156 aa, Heterodera glycines
  Homolog annotation: Hit_ID=AAK02015.1; Match level="QueryCoverage =57%, HitCoverage=42%, E-value=3e-09, Identity=31%"; Hit description =enterophilin-2S [Cavia porcellus]
  Coding regions on vcDNA: vcDNA=SeqID_96766; Strand=+; Position=1-471
DMEELWKQSQKIQTDNHELSERVSSLTRENNTLRTEHERILGDHNTLRTEHERILVDHNTLRTEQERILVDHNTLRTEYERLLQRQLDDFHYWILCFAFFIPPLSILATARNNGLSFPVTVLSALAATIFCAFLWIPGILFALAFYFGLRKNAKKE

SEQ ID NO: 170344 - protein, 90 aa, Heterodera glycines; identical to SEQ ID NO: 168444
  misc_feature (62)..(62): Xaa can be any naturally occurring amino acid
  Homolog annotation: Hit_ID=NP_573176.1; Match level="QueryCoverage =88%, HitCoverage=33%, E-value=2e-11, Identity=50%"; Hit description =CG9099-PA [Drosophila melanogaster] gb|AAF48679.3| CG9099-PA [Drosophila melanogaster] gb|AAL28305.1| GH2
  Coding regions on vcDNA: vcDNA=SeqID_96767; Strand=+; Position=71-343

SEQ ID NO: 170345 - protein, 79 aa, Heterodera glycines; identical to SEQ ID NO: 162277
  Coding regions on vcDNA: vcDNA=SeqID_96768; Strand=+; Position=32-271

SEQ ID NO: 170346 - protein, 85 aa, Heterodera glycines
  Coding regions on vcDNA: vcDNA=SeqID_96769; Strand=-; Position=81-338
LFPLHLILRMFVSNSVFLPVSRFFHCRALSAVNLVVHPFVARKCAFLSTPSLSFPFRRQYSSLASATTTGASNDKPNTSDGSSGC

SEQ ID NO: 170347 - protein, 103 aa, Heterodera glycines
  Coding regions on vcDNA: vcDNA=SeqID_96770; Strand=-; Position=2-310
CIIIISINSFIFQFFSLLDLALIFRLFFGRFLLGTMVQSFFDAGRRHCGGNARGRSDGGTFGQLFAGHSAFLTNYNWSSHHHCWKHQSFNQQQNANYSEAIHF

SEQ ID NO: 170348 - protein, 118 aa, Heterodera glycines; identical to SEQ ID NO: 168439
  Coding regions on vcDNA: vcDNA=SeqID_96771; Strand=+; Position=1-354

SEQ ID NO: 170349 - protein, 58 aa, Heterodera glycines
  Coding regions on vcDNA: vcDNA=SeqID_96772; Strand=+; Position=15-191
IIPKMISSQMFFLALLFICASLLCLFTASSAASDDGLENENPSKNVRNFLAEFGDNGH

SEQ ID NO: 170350 - protein, 80 aa, Heterodera glycines; identical to SEQ ID NO: 140683
  Coding regions on vcDNA: vcDNA=SeqID_96773; Strand=-; Position=1-240

SEQ ID NO: 170351 - protein, 82 aa, Heterodera glycines; identical to SEQ ID NO: 132020
  Homolog annotation: Hit_ID=CAE74190.1; Match level="QueryCoverage =62%, HitCoverage=45%, E-value=9e-17, Identity=71%"; Hit description =Hypothetical protein CBG21865 [Caenorhabditis briggsae]
  Gene Ontology: Mol. function=thiol-disulfide exchange intermediate activity; Cellular component=intracellular; Biological process =response to oxidative stress
  Coding regions on vcDNA: vcDNA=SeqID_96774; Strand=-; Position=3-248

SEQ ID NO: 170352 - protein, 72 aa, Heterodera glycines; identical to SEQ ID NO: 164388
  Coding regions on vcDNA: vcDNA=SeqID_96775; Strand=-; Position=112-330

SEQ ID NO: 170353 - protein, 182 aa, Heterodera glycines
  Homolog annotation: Hit_ID=NP_499298.1; Match level="QueryCoverage =87%, HitCoverage=25%, E-value=4e-09, Identity=29%"; Hit description =FtsH protease (3L509) [Caenorhabditis elegans] emb|CAA88955.1| Hypothetical protein M03C11.5 [Caenorhabdi
  Coding regions on vcDNA: vcDNA=SeqID_96776; Strand=+; Position=200-745
MNGQIINSDELKIVFTHKALHTLIAYYSDVAVPTGTTVNRDGCGLTKRRFLCPSVKTKEQMIFEIDFRISATIGEKIMFGKKHDGSTDDLREATRMILDMVNSGMFYDELGLREFTVAPPGPALKNKLDKFVDRKLNECVARVEKLVNNKKDEVKDLAEHLEASDGWHLNEEQIHQFFKRRN

SEQ ID NO: 170354 - protein, 163 aa, Heterodera glycines
  Homolog annotation: Hit_ID=NP_495878.1; Match level="QueryCoverage =100%, HitCoverage=85%, E-value=3e-66, Identity=69%"; Hit description= integral membrane protein -related (22.6 kD) (2J103) [Caenorhabditis elegans] emb|CAA91047.1| Hypothetic
  Gene Ontology: Cellular component=COPII-coated vesicle; Biological process=protein targeting
  Coding regions on vcDNA: vcDNA=SeqID_96777; Strand=+; Position=25-513
MNDDIRDQPGTCSRIFSLIGIKYQYYLDRLTPYTAVRWTIAITLIVFFVWRIVAIQGFYIVTYALFIYYLNLFLAFLTPKIDPAVEYDEDDDGPVLPSSTNEEFRPFMRRLPEFKFWLSTMKSTLVAFGCTFFEMFDIPVFWPILVTYFIVLTTLTMKRQIMH

SEQ ID NO: 170355 - protein, 131 aa, Heterodera glycines
  Coding regions on vcDNA: vcDNA=SeqID_96778; Strand=+; Position=98-493
FSTNIFNFWEFVSLHLGPIFHILYLKNRAPSPVIISAKMRSKCVFLVIFATIFLLLNGGTSSKHKSAKSGVSLVQKSVTLASLLRQPSQTEVVTRTMSQQWEVQHDMYDYDHYPKDDGPKEKGSKNCCTIM

SEQ ID NO: 170356 - protein, 35 aa, Heterodera glycines
  Coding regions on vcDNA: vcDNA=SeqID_96779; Strand=+; Position=10-117
MPNPSTFFLRVRMKTGNRIRYNAKRRHWRRTKLKL

SEQ ID NO: 170357 - protein, 130 aa, Heterodera glycines
  Coding regions on vcDNA: vcDNA=SeqID_96780; Strand=+; Position=49-441
MSTIPMPPPPTQDEKDQQKKSQWKPLEIGNRMRTTSEDSAESFDAYGPEWEGKGRGIGNRREFSSPNMTSSGRRMSITERLFGRPVPQERRNSLGEEQMGQEKPKSIAENKDFKELMKRQRKILGDDEWQ

SEQ ID NO: 170358 - protein, 88 aa, Heterodera glycines; identical to SEQ ID NO: 168429
  Homolog annotation: Hit_ID=AAK92156.1; Match level="QueryCoverage =95%, HitCoverage=41%, E-value=5e-31, Identity=72%"; Hit description =ribosomal protein L13A [Spodoptera frugiperda] sp|Q962U0|R13A_SPOFR 60S ribosomal protein L13A
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_96781; Strand=+; Position=1-267

SEQ ID NO: 170359 - protein, 136 aa, Heterodera glycines
  Coding regions on vcDNA: vcDNA=SeqID_96782; Strand=+; Position=2-412
NTTFTAALISDGRAENQLEQKKPSQLHSLPFSMDFNGPALVSKFFQTEDGANGLKAALFRGHLLLGKTVRAPEGFAFYAVKESEHSQSEEGEMSTYNVVDSVPSMDVWEYDEPPESRKKCLQNALVALQVANDLAS

SEQ ID NO: 170360 - protein, 64 aa, Heterodera glycines
  Coding regions on vcDNA: vcDNA=SeqID_96783; Strand=-; Position=0-191
LKMYFVGVKNHTPKVVQPQKSDAIDNGTISPFGNGSAPRRKPGHWVPAPFFVNRDQTTKFRCSA

SEQ ID NO: 170361 - protein, 71 aa, Heterodera glycines
  Homolog annotation: Hit_ID=CAA71575.1; Match level="QueryCoverage =53%, HitCoverage=17%, E-value=2e-13, Identity=100%"; Hit description= fused-ccdB [Cloning vector pZeRO-2T]
  Coding regions on vcDNA: vcDNA=SeqID_96784; Strand=-; Position=159-374
MTMITPSYLGDTIEYSSYASSLVPSSDPLVTAASVLEFALERELVSSFFFFFFFFLKKILFFPIYVNLLRT

SEQ ID NO: 170362 - protein, 119 aa, Heterodera glycines
  misc_feature (91)..(92): Xaa can be any naturally occurring amino acid
  Homolog annotation: Hit_ID=AAL78212.1; Match level="QueryCoverage =96%, HitCoverage=99%, E-value=1e-35, Identity=59%"; Hit description =putative esophageal gland cell secretory protein Hgg-25 [Heterodera glycines]
  Coding regions on vcDNA: vcDNA=SeqID_96785; Strand=+; Position=71-427
MRTFLFIAVVGLMLAVILENVNATGKNSPTKGKQSLDSPNHEKDHKNEHEKYEAAYFQTGSSGSPKKGKSPHADPKKAASHLVPVTPGKVXXASLKMVKKLCGAMMPTMNKPKAVEVDV

SEQ ID NO: 170363 - protein, 152 aa, Heterodera glycines
  Coding regions on vcDNA: vcDNA=SeqID_96786; Strand=-; Position=1-456
RRECREMPSIEMPPIRPTRFFVPRPFRHHLRPAAHFRSNVQKCPPFSPIRRPSLPHIAGDPGKCWRITSITSRTFLASFRPAKLLDCFPSVCVMSNTSSSVVGIAQLKNGQKPCLLTWAEGHGPWPMCWHFAYLAKPAASDVSHSGQMQADI

SEQ ID NO: 170364 - protein, 69 aa, Heterodera glycines
  Homolog annotation: Hit_ID=CAG85767.1; Match level="QueryCoverage =82%, HitCoverage=100%, E-value=3e-16, Identity=70%"; Hit description= unnamed protein product [Debaryomyces hansenii CBS767] ref|XP _457739.1| unnamed protein product [Debaryom
  Coding regions on vcDNA: vcDNA=SeqID_96787; Strand=+; Position=1-210
PNNHFYPFSYSNMAVTFADFFKVICAIILPPLGVFVETGCSIHLLINIILTILGYIPGIIHALYIIFQY

SEQ ID NO: 170365 - protein, 121 aa, Heterodera glycines
  Homolog annotation: Hit_ID=CAE66673.1; Match level="QueryCoverage =99%, HitCoverage=90%, E-value=3e-51, Identity=75%"; Hit description =Hypothetical protein CBG12012 [Caenorhabditis briggsae]
  Coding regions on vcDNA: vcDNA=SeqID_96788; Strand=+; Position=1-366
ALYKTLCKLGDNLVYPILPAFAKPAWNHPAGPKTVFFWSPTIKWVLVGAGLSDLARPANKLSIYQNTALMATGMIWTRYCFVIVPKNYYLASVNFFVGCTGLAQILRIAHYQYIHSEETSK

SEQ ID NO: 170366 - protein, 38 aa, Heterodera glycines; identical to SEQ ID NO: 145447
  Coding regions on vcDNA: vcDNA=SeqID_96789; Strand=+; Position=3-119

SEQ ID NO: 170367 - protein, 66 aa, Heterodera glycines
  Coding regions on vcDNA: vcDNA=SeqID_96790; Strand=+; Position=46-243
LPKKQSLPSLFDPPKLLVIILFYHNDQNGLWIIFENFLPKKLNFLFYFALKIYVIMCDQILTMDFL

SEQ ID NO: 170368 - protein, 101 aa, Heterodera glycines; identical to SEQ ID NO: 163337
  Homolog annotation: Hit_ID=NP_872192.1; Match level="QueryCoverage =99%, HitCoverage=69%, E-value=3e-32, Identity=62%"; Hit description =transthyretin-like family member (15.7 kD) (5I318) [Caenorhabditis elegans] gb|AAN84848.1| Hypothetical p
  Coding regions on vcDNA: vcDNA=SeqID_96791; Strand=+; Position=178-483

SEQ ID NO: 170369 - protein, 114 aa, Heterodera glycines; identical to SEQ ID NO: 168422
  Homolog annotation: Hit_ID=CAE59298.1; Match level="QueryCoverage =98%, HitCoverage=91%, E-value=2e-52, Identity=84%"; Hit description =Hypothetical protein CBG02633 [Caenorhabditis briggsae]
  Gene Ontology: Mol. function=tubulin binding; Cellular component =plasma membrane; Biological process=microtubule cytoskeleton organization and biogenesis
  Coding regions on vcDNA: vcDNA=SeqID_96792; Strand=+; Position=2-346

SEQ ID NO: 170370 - protein, 81 aa, Heterodera glycines
  Homolog annotation: Hit_ID=NP_508785.2; Match level="QueryCoverage =75%, HitCoverage=21%, E-value=2e-10, Identity=50%"; Hit description =lysosomal-associated transmembrane protein (26.6 kD) (XF199) [Caenorhabditis elegans] gb|AAA96192.3| Hypo
  Coding regions on vcDNA: vcDNA=SeqID_96793; Strand=+; Position=158-400
MRATNGRLGNLVRSPLARNKYLNNGEAKMQRRHSSAGEEMPRAVQFDESSDQYRCLCGCFHVKTGTYLIASNLKMAPNLVP

SEQ ID NO: 170371 - protein, 149 aa, Heterodera glycines
  Coding regions on vcDNA: vcDNA=SeqID_96794; Strand=+; Position=40-489
MFCRCFPHSFLLLLPVLLALLSLFKCISASNHQPQAENVLLEELIQEIRKLNDRMEPALGREGNAEEEQMLEIKRSQGMVPSELWNRAGDKRAQLPFSGGIYGKRSPLPFSGGIYGKRSARNLYSSSLIFPTLNRQARAMPFNDGMYGK

SEQ ID NO: 170372 - protein, 193 aa, Heterodera glycines
  Homolog annotation: Hit_ID=NP_509652.2; Match level="QueryCoverage =98%, HitCoverage=89%, E-value=7e-36, Identity=42%"; Hit description =glutathione S-Transferase (23.9 kD) (gst-36) [Caenorhabditis elegans] emb|CAA88541.2| Hypothetical protei
  Gene Ontology: Mol. function=glutathione transferase activity; Biological process=glutathione conjugation reaction
  Coding regions on vcDNA: vcDNA=SeqID_96795; Strand=+; Position=4-582
QPKLYYFAGVRGRGEYIRQILKFAKVPFEEVSINIEDWPKYKEEMPLGQLPVLEVNGVKFSQSLAISRYLGETYGLSFNDPLERALLNMIVDQISDTQNSGAFKEWPMVRLDLVPCGDKAAFFREKIRPQLDGCASLVEKYLVEKGDGILLGKDKITWADIYAAEFFAKCIHFGEKDCLEAYPQIKSLIARVQ

SEQ ID NO: 170373 - protein, 117 aa, Heterodera glycines
  Homolog annotation: Hit_ID=AAO49799.1; Match level="QueryCoverage =90%, HitCoverage=27%, E-value=2e-36, Identity=79%"; Hit description =arginine kinase [Heterodera glycines]
  Gene Ontology: Mol. function=creatine kinase activity; Cellular component=cytoplasm; Biological process=muscle contraction
  Coding regions on vcDNA: vcDNA=SeqID_96796; Strand=+; Position=8-361
MRRLPLTLAGTPPSRTIRLAFVTHALQGYPFNPCLMGTTVRASVHIRLPKISANHDDFKSICEELKLQIRGIHGEHSESAGGVYDISNKARLGLTEFEAVKQMYDGVKHLIELEKKA

SEQ ID NO: 170374 - protein, 71 aa, Heterodera glycines; identical to SEQ ID NO: 125602
  Coding regions on vcDNA: vcDNA=SeqID_96797; Strand=+; Position=2-217

SEQ ID NO: 170375 - protein, 64 aa, Heterodera glycines; identical to SEQ ID NO: 168228
  Homolog annotation: Hit_ID=NP_492097.1; Match level="QueryCoverage =87%, HitCoverage=4%, E-value=3e-11, Identity=64%"; Hit description =related kinase (1I38) [Caenorhabditis elegans] emb|CAA98148.1| Hypothetical protein ZK524.4 [Caenorhabditi
  Coding regions on vcDNA: vcDNA=SeqID_96798; Strand=+; Position=111-302

SEQ ID NO: 170376 - protein, 118 aa, Heterodera glycines
  Coding regions on vcDNA: vcDNA=SeqID_96799; Strand=-; Position=3-356
LTQQMVRNGKAVTICDQMNMRKRNKSLADNQSIPLFSFVVDGGGRVFRQNIIHLLAQMERVLVRHFPEKCLNHFGTVLCCSYCSTSSRTLSINRLDSSKKHSGMGANALCSASARIIR

SEQ ID NO: 170377 - protein, 54 aa, Heterodera glycines; identical to SEQ ID NO: 164340
  Coding regions on vcDNA: vcDNA=SeqID_96800; Strand=+; Position=1-165

SEQ ID NO: 170378 - protein, 88 aa, Heterodera glycines
  Coding regions on vcDNA: vcDNA=SeqID_96801; Strand=-; Position=146-412
FLRQQFLSANKCNINGITSQQILHSENVKISSWSVEVFRFLCLLLLLLFSSYSGATVKRNFICGLFTWYTPFSETASAGLPFTVASYL

SEQ ID NO: 170379 - protein, 107 aa, Heterodera glycines; identical to SEQ ID NO: 164400
  Coding regions on vcDNA: vcDNA=SeqID_96802; Strand=-; Position=87-410

SEQ ID NO: 170380 - protein, 92 aa, Heterodera glycines; identical to SEQ ID NO: 164367
  Coding regions on vcDNA: vcDNA=SeqID_96803; Strand=+; Position=20-298

SEQ ID NO: 170381 - protein, 76 aa, Heterodera glycines
  Homolog annotation: Hit_ID=CAE59427.1; Match level="QueryCoverage =100%, HitCoverage=97%, E-value=3e-14, Identity=41%"; Hit description= Hypothetical protein CBG02799 [Caenorhabditis briggsae]
  Coding regions on vcDNA: vcDNA=SeqID_96804; Strand=+; Position=135-365
MVCVPCIILPVVLAIYLRFVQPYILRFMPQRWRIWFDSVLYPTCPVNKMETTNKSKTEKNKTDGEGETGKECEKDK

SEQ ID NO: 170382 - protein, 103 aa, Heterodera glycines
  Homolog annotation: Hit_ID=AAO92292.1; Match level="QueryCoverage =100%, HitCoverage=99%, E-value=2e-49, Identity=98%"; Hit description= FMRFamide-related peptide precursor [Heterodera glycines]
  Coding regions on vcDNA: vcDNA=SeqID_96805; Strand=+; Position=3-314
ALQISNTVFMLIVLATSLLLLMPSSSNAKVMPQLGFANAEQLMNDNSSPMGAGVEGEVMDKVEARLLGALELLQSYKEVPIVPKFTEKRKNKFEFIRFGKRRR

SEQ ID NO: 170383 - protein, 62 aa, Heterodera glycines
  Coding regions on vcDNA: vcDNA=SeqID_96806; Strand=-; Position=33-221
SWLASSFHAVSSPSPPSQSSATDADAAAGIGTVTRNVPEFVATIAFRIRAHLPLFLLLPFLF

SEQ ID NO: 170384 - protein, 105 aa, Heterodera glycines
  Homolog annotation: Hit_ID=CAE67641.1; Match level="QueryCoverage =98%, HitCoverage=99%, E-value=3e-15, Identity=40%"; Hit description =Hypothetical protein CBG13200 [Caenorhabditis briggsae]
  Coding regions on vcDNA: vcDNA=SeqID_96807; Strand=+; Position=18-335
MADLQKLSGADRLLLCRRYFHVGFVCLPLLWAVNAIWFFRYAFPSGANATAETAQIRRYVCWSATGALCWGLLLTGWLFFYNIQRSYGLFDWPEKITAVFPLGYV

SEQ ID NO: 170385 - protein, 128 aa, Heterodera glycines
  Coding regions on vcDNA: vcDNA=SeqID_96808; Strand=-; Position=1-384
LSDQCFHLFAADLLSVDQCCCCCCCCCCWYCWYCWYFFFSNSYFSPDPMCMCALQNHIGMRWPAMNCMYINPSSREQLPGCSGQSQIAQMKQLLCIVNFSTWTFSSKISIHVLQIWQNFFVGPVPKFI

SEQ ID NO: 170386 - protein, 70 aa, Heterodera glycines; identical to SEQ ID NO: 164434
  Homolog annotation: Hit_ID=CAE64705.1; Match level="QueryCoverage =95%, HitCoverage=62%, E-value=2e-15, Identity=55%"; Hit description =Hypothetical protein CBG09491 [Caenorhabditis briggsae]
  Coding regions on vcDNA: vcDNA=SeqID_96809; Strand=+; Position=26-238

SEQ ID NO: 170387 - protein, 69 aa, Heterodera glycines
  misc_feature (40)..(40): Xaa can be any naturally occurring amino acid
  Homolog annotation: Hit_ID=CAE64705.1; Match level="QueryCoverage =95%, HitCoverage=62%, E-value=1e-13, Identity=53%"; Hit description =Hypothetical protein CBG09491 [Caenorhabditis briggsae]
  Coding regions on vcDNA: vcDNA=SeqID_96810; Strand=+; Position=22-230
MAKKTKYLIVRLASVISGTKQIWVRERAAAEAAAILYDPXGKNVLFKEVEQVKGKDSFPDRVKKMYNIS

SEQ ID NO: 170388 - protein, 96 aa, Heterodera glycines
  Coding regions on vcDNA: vcDNA=SeqID_96811; Strand=-; Position=94-384
SLFHANVSVWPSDHSPSDQCHSIDRSSHQFCFFFGCLTCLPNALSFASFCCCCCCCCTPPAIPFPLLILFWLLMFDGLVLLLSEVVALGIGGLLMA

SEQ ID NO: 170389 - protein, 105 aa, Heterodera glycines; identical to SEQ ID NO: 164420
  Coding regions on vcDNA: vcDNA=SeqID_96812; Strand=-; Position=1-315

SEQ ID NO: 170390 - protein, 110 aa, Heterodera glycines
  Homolog annotation: Hit_ID=NP_498776.1; Match level="QueryCoverage =91%, HitCoverage=91%, E-value=2e-25, Identity=49%"; Hit description =heat shock protein (hsp-12.2) [Caenorhabditis elegans] gb|AAA27953.1| Heat shock protein protein 12.2 [Ca
  Gene Ontology: Mol. function=chaperone activity; Cellular component =cytoplasm; Biological process=muscle contraction
  Coding regions on vcDNA: vcDNA=SeqID_96813; Strand=+; Position=3-335
NQIKVDQEESTKLWDWPLQSHDELVSIYDGRDRWEVGLDTGFFTPNEIEVNRMGQNLFIHCKHDQREGMLGTTSREVQRNYKLPDDVDPKSIRSNITRAGILRITAQKKR

SEQ ID NO: 170391 - protein, 56 aa, Heterodera glycines; identical to SEQ ID NO: 168412
  Coding regions on vcDNA: vcDNA=SeqID_96814; Strand=+; Position=3-173

SEQ ID NO: 170392 - protein, 128 aa, Heterodera glycines
  Coding regions on vcDNA: vcDNA=SeqID_96815; Strand=+; Position=20-406
LKNKMRTNCLALSSLAIFYSAVFSAIGAPVEPSTKERAKHGVAAHYLKAEDEKLEKIKQMLEEQSPKMSPKGKQIATKFVEILLNKKLTYEEFRKEILKLDNETDAKTNDEFAKSEFAKQMSLIEKHS

SEQ ID NO: 170393 - protein, 111 aa, Heterodera glycines
  Coding regions on vcDNA: vcDNA=SeqID_96816; Strand=+; Position=8-343
VRSPFFILPFFSAIGAPVEPSTKEREKHGVAAHYLKAEDEKLEKIKQMLEEQSPKMSPKGKQIATKFVEILLNKKLTYEEFRKEILKLDNETDAKTNDEFAKQMSLIEKHS

SEQ ID NO: 170394 - protein, 129 aa, Heterodera glycines
  Coding regions on vcDNA: vcDNA=SeqID_96817; Strand=+; Position=29-418
MVVVLSALSSGTFPPHFSLRWHSLSFLLVFILLTVRFSADFTNCHSVPSLMAFDPTKLRRLLPIREFLSDDQLAFERAIRQPAGGVKWMRFGKRTPQGKWMRFGKRKMAIEGGKWVRFGKRAEEMQGEE

SEQ ID NO: 170395 - protein, 167 aa, Heterodera glycines
  misc_feature (155)..(155): Xaa can be any naturally occurring amino acid
  Homolog annotation: Hit_ID=CAE67929.1; Match level="QueryCoverage =97%, HitCoverage=92%, E-value=3e-35, Identity=44%"; Hit description =Hypothetical protein CBG13529 [Caenorhabditis briggsae]
  Gene Ontology: Cellular component=extracellular space
  Coding regions on vcDNA: vcDNA=SeqID_96818; Strand=+; Position=2-502
MKPTFLMLISTCIIALVYASAEYDECEVCTDLFTEVMKKVDESGEKGEPAVKKMIIEHCKSVKGVDDKKEKLCFFIGAHPDSSTSVLGDIAKPLSFHKPPNKVCSQLKERDSQICALKYDKPIDWDSLVLEKMRLTQLKELLLKIGDSCKGCTDXVDYITRINELRA

SEQ ID NO: 170396 - protein, 136 aa, Heterodera glycines
  Homolog annotation: Hit_ID=CAE69837.1; Match level="QueryCoverage =96%, HitCoverage=92%, E-value=3e-29, Identity=45%"; Hit description =Hypothetical protein CBG16161 [Caenorhabditis briggsae]
  Coding regions on vcDNA: vcDNA=SeqID_96819; Strand=+; Position=2-412
ISLIVLGILLTNLEAFRQQTVGIRGRLMCGNQPLKDANVKLWNKNTLGSDDQLAANRTDNHGNYELQGGVGQLTKMNVHFKVYHDCDDGIKPCQRKVNFGVPDHYVERSGSTKKWFEAGTMNMEFKYPDEERSCIN

SEQ ID NO: 170397 - protein, 129 aa, Heterodera glycines
  Coding regions on vcDNA: vcDNA=SeqID_96820; Strand=+; Position=1-390
EFGIGDRFLLVLISSAIVYKIFPFSVFVALFSFIVASWIYFQYRQKQHWHNVGVPGPNTNILFGNTLKQFRTGVIEVDEEMFKKYGNSYGSFLFERREFCTKDPKMLRQIFIKEFSHFQNRYVILWMKI

SEQ ID NO: 170398 - protein, 59 aa, Heterodera glycines; identical to SEQ ID NO: 168407
  Coding regions on vcDNA: vcDNA=SeqID_96821; Strand=-; Position=95-274

SEQ ID NO: 170399 - protein, 47 aa, Heterodera glycines; identical to SEQ ID NO: 168406
  Coding regions on vcDNA: vcDNA=SeqID_96822; Strand=-; Position=2-142

SEQ ID NO: 170400 - protein, 106 aa, Heterodera glycines; identical to SEQ ID NO: 138111
  Coding regions on vcDNA: vcDNA=SeqID_96823; Strand=+; Position=5-325

SEQ ID NO: 170401 - protein, 77 aa, Heterodera glycines; identical to SEQ ID NO: 164406
  Coding regions on vcDNA: vcDNA=SeqID_96824; Strand=+; Position=2-235

SEQ ID NO: 170402 - protein, 113 aa, Heterodera glycines; identical to SEQ ID NO: 164358
  Coding regions on vcDNA: vcDNA=SeqID_96825; Strand=-; Position=54-395

SEQ ID NO: 170403 - protein, 151 aa, Heterodera glycines
  Coding regions on vcDNA: vcDNA=SeqID_96826; Strand=-; Position=2-454
HQIYQFDIKMVMFGYIVSLKNVQMPFIHFVSFVCLPLPFLLSLSLTLSVCLPLPFLHSLFHFFPSLFLSFPHFPIALHSFTAFFPHSAHFGAAGFLHSFLHLPLAHFTQSVAHLLFVFGHTLLHSSMIKLASLKEFNATTKIRQKRRKARE

SEQ ID NO: 170404 - protein, 106 aa, Heterodera glycines; identical to SEQ ID NO: 162285
  Coding regions on vcDNA: vcDNA=SeqID_96827; Strand=+; Position=2-322

SEQ ID NO: 170405 - protein, 134 aa, Heterodera glycines
  misc_feature (132)..(132): Xaa can be any naturally occurring amino acid
  Coding regions on vcDNA: vcDNA=SeqID_96828; Strand=+; Position=160-561
HIFQYTFEHEKAAIFRWEKERRSERVEEETEQTQQMRKQRQRHMEEKGTKKDGERERAEEGQRRTERRRDNTLNNPEYRNGECFKIESHSLPSSNVSKPNQPPHFASSSLLKPVPMSKSSSNSLHVGIASTXNG

SEQ ID NO: 170406 - protein, 76 aa, Heterodera glycines; identical to SEQ ID NO: 168400
  Homolog annotation: Hit_ID=CAE64705.1; Match level="QueryCoverage =84%, HitCoverage=59%, E-value=7e-15, Identity=56%"; Hit description =Hypothetical protein CBG09491 [Caenorhabditis briggsae]
  Coding regions on vcDNA: vcDNA=SeqID_96829; Strand=+; Position=54-284

SEQ ID NO: 170407 - protein, 84 aa, Heterodera glycines; identical to SEQ ID NO: 168397
  Coding regions on vcDNA: vcDNA=SeqID_96830; Strand=+; Position=68-322

SEQ ID NO: 170408 - protein, 105 aa, Heterodera glycines; identical to SEQ ID NO: 163825
  Coding regions on vcDNA: vcDNA=SeqID_96831; Strand=+; Position=29-346

SEQ ID NO: 170409 - protein, 105 aa, Heterodera glycines
  Coding regions on vcDNA: vcDNA=SeqID_96832; Strand=+; Position=40-357
NILRKWQSLHRKWQQLRNLNTSPAYTTKRTLSNPTTVVQTQEASLNQQKMWSLLNGPKRKCKSKNTVRSSLLRRNTNGQKWNRIEKKSKRRKCISFGLIKRSFDD

SEQ ID NO: 170410 - protein, 120 aa, Heterodera glycines; identical to SEQ ID NO: 164419
  Coding regions on vcDNA: vcDNA=SeqID_96833; Strand=-; Position=1-360

SEQ ID NO: 170411 - protein, 72 aa, Heterodera glycines
  Homolog annotation: Hit_ID=NP_491663.1; Match level="QueryCoverage =91%, HitCoverage=37%, E-value=1e-13, Identity=52%"; Hit description =adenine phosphoribosyltransferase (20.2 kD) (1G247) [Caenorhabditis elegans] gb|AAB37633.1| Hypothetical
  Gene Ontology: Mol. function=adenine phosphoribosyltransferase activity; Biological process=nucleotide metabolism
  Coding regions on vcDNA: vcDNA=SeqID_96834; Strand=+; Position=2-220
MIRSICAHIVTLYRQKIDVVVALEARGFLFGPIVALEMDVPFVPVRKRGKLPGSVFSATYVKEYGQAILLMY

SEQ ID NO: 170412 - protein, 183 aa, Heterodera glycines
  Coding regions on vcDNA: vcDNA=SeqID_96835; Strand=+; Position=1-549
SLSKGSLGVEGLAGLLMDTAKKSTKVPYEEKTDESTQKGQTQIGTSNEGDEGAKEGKTNGRSISGKKTTAKEHYLSKSRYMPGLRSNGSSSLSAGINRKAIAQPSQQSGAKQTTGGGILSSVQVTSLLLVRLANNRRMPIQMRTHWAIRRPQFQSVADRRTMPKQTTPSQPSEDGRIGRQNIS

SEQ ID NO: 170413 - protein, 42 aa, Heterodera glycines
  Coding regions on vcDNA: vcDNA=SeqID_96836; Strand=+; Position=1-129
AVDAQQIIELILCLILPPLAIFIHANSDCNVHVLISIVLWYF

SEQ ID NO: 170414 - protein, 81 aa, Heterodera glycines
  Homolog annotation: Hit_ID=NP_001006464.1; Match level="QueryCoverage= 97%, HitCoverage=100%, E-value=8e-23, Identity=62%"; Hit description =similar to chromosome 11 open reading frame 10 [Gallus gallus] ref|NP_055021.1| chromosome 11 open re
  Coding regions on vcDNA: vcDNA=SeqID_96837; Strand=+; Position=35-280
MVVDISKMEPFSPPVSHALFPHLTTVLLSIGLIFTAWFFVHGVTSTKKTRNLVKELFIGTLASLFLGFGTLFLMLWVGIYV

SEQ ID NO: 170415 - protein, 100 aa, Heterodera glycines
  Coding regions on vcDNA: vcDNA=SeqID_96838; Strand=+; Position=2-301
CEMVVLSKLGSPLRPFSNDYLLCRFQAFRNYAIKKERPPPAKIQVPPPANETGHWKYERDYSYDLRYSNPINKYSSFTRFITLTATGHKELWALFALLML

SEQ ID NO: 170416 - protein, 160 aa, Heterodera glycines
  Coding regions on vcDNA: vcDNA=SeqID_96839; Strand=+; Position=1-480
IFLFIVMINALGCSNAQLKCRRDTVGTINGVGLKMNFSEEECESTYFWQSAYKYCYASHCLRGNEWLTHYGCAKSPEKGACSDNVEKEMKDLYGLAVSCSFCTIGRKMDDMSNKNFPLYNTTNVVMPPSGGADGDDFSFMSTTQQLTTSYNLSEIATIVP

SEQ ID NO: 170417 - protein, 77 aa, Heterodera glycines
  Coding regions on vcDNA: vcDNA=SeqID_96840; Strand=-; Position=3-233
NCSIFFSFQQMQLCCPYFSQQAKRPAQFVAPAANKHSSNPSARFATNFANSCSCIGVPTTSAKPKKAKRIKNDKISN

SEQ ID NO: 170418 - protein, 75 aa, Heterodera glycines
  Coding regions on vcDNA: vcDNA=SeqID_96841; Strand=-; Position=3-227
SDHCHSFRSIILYQSPNLFQFNTFSRGFSKINFASVIYSFNCDPSTINEIHFLFCCLRTLGKIAKKTQKTANRRE

SEQ ID NO: 170419 - protein, 147 aa, Heterodera glycines; identical to SEQ ID NO: 164360
  Homolog annotation: Hit_ID=AAN05585.1; Match level="QueryCoverage =97%, HitCoverage=94%, E-value=6e-64, Identity=77%"; Hit description =ribosomal protein L22 [Argopecten irradians]
  Gene Ontology: Mol. function=structural constituent of ribosome; Cellular component=cytosolic ribosome (sensu Eukarya); Biological process=protein biosynthesis
  Coding regions on vcDNA: vcDNA=SeqID_96842; Strand=+; Position=23-466

SEQ ID NO: 170420 - protein, 164 aa, Heterodera glycines
  Homolog annotation: Hit_ID=CAE66687.1; Match level="QueryCoverage =96%, HitCoverage=92%, E-value=4e-55, Identity=65%"; Hit description =Hypothetical protein CBG12026 [Caenorhabditis briggsae]
  Gene Ontology: Mol. function=iron ion binding; Cellular component =ferritin complex; Biological process=iron ion homeostasis
  Coding regions on vcDNA: vcDNA=SeqID_96843; Strand=+; Position=22-513
MAQHQESLIRQNFAAETEAGINKQINIELYASYVYLSMSFYFDREDVALHNIAKWFKKQSDEERGHGTTFMKYQNSRGGRIVLQNVQKPEKGEWGSALEAFQAALALEKFNNQSLLELHNLASQQGDSQMCDCLEDKYLREQVELMEEIGKIITNLERGGKGLG

SEQ ID NO: 170421 - protein, 119 aa, Heterodera glycines; identical to SEQ ID NO: 168381
  Coding regions on vcDNA: vcDNA=SeqID_96844; Strand=+; Position=1-360

SEQ ID NO: 170422 - protein, 84 aa, Heterodera glycines; identical to SEQ ID NO: 168380
  Coding regions on vcDNA: vcDNA=SeqID_96845; Strand=+; Position=131-385

SEQ ID NO: 170423 - protein, 37 aa, Heterodera glycines
  Coding regions on vcDNA: vcDNA=SeqID_96846; Strand=-; Position=3-113
FGYLHRLKIKHKNWGPTRFGAPVSALVFRRSRFAPMQ

SEQ ID NO: 170424 - protein, 120 aa, Heterodera glycines; identical to SEQ ID NO: 164369
  Coding regions on vcDNA: vcDNA=SeqID_96847; Strand=+; Position=1-363

SEQ ID NO: 170425 - protein, 79 aa, Heterodera glycines; identical to SEQ ID NO: 168376
  Coding regions on vcDNA: vcDNA=SeqID_96848; Strand=-; Position=2-238

SEQ ID NO: 170426 - protein, 74 aa, Heterodera glycines; identical to SEQ ID NO: 127829
  Coding regions on vcDNA: vcDNA=SeqID_96849; Strand=-; Position=2-223

SEQ ID NO: 170427 - protein, 151 aa, Heterodera glycines
  Coding regions on vcDNA: vcDNA=SeqID_96850; Strand=+; Position=2-457
VIPSLLNCPARNLCDRLNHPDEIQKVEKYLKGKTLQTTYKNQLDEYKDFEYGGITRESARKQMAYNGFKNVTVDQHFYVRYRICLRYANNPCVIEKHRNGHERFYPLELVKLKYVDKNNIYLGQNFPKSIPLLDENNSKYNDNYYDSCRLW

SEQ ID NO: 170428 - protein, 99 aa, Heterodera glycines
  Homolog annotation: Hit_ID=NP_495943.1; Match level="QueryCoverage =90%, HitCoverage=94%, E-value=1e-28, Identity=64%"; Hit description =dynein light (10.7 kD) (2J396) [Caenorhabditis elegans] emb|CAA90946.1| Hypothetical protein T24H10.6 [Ca
  Coding regions on vcDNA: vcDNA=SeqID_96851; Strand=+; Position=3-302
TLTTTDVEETIKRIQSQKGVTGVIIMDNIGRAIRSTFDDDTTAHHAALLQQLCERSKNVVREMDTSNDLSFMRLRTKKNEIMIAPDKDYLIAVIYKKSR

SEQ ID NO: 170429 - protein, 88 aa, Heterodera glycines; identical to SEQ ID NO: 164350
  Coding regions on vcDNA: vcDNA=SeqID_96852; Strand=-; Position=3-266

SEQ ID NO: 170430 - protein, 108 aa, Heterodera glycines
  Coding regions on vcDNA: vcDNA=SeqID_96853; Strand=+; Position=3-329
HQSHLFLMGVASADDDSVPDPIVIKLGESLSLSQLVQKIEQLQNRTVRELLVTLRRRTYEMPVGPPDPNGDRFFQNGHLLVEDVVYNWVRKTRNSIHGIVQLHVIRNF

SEQ ID NO: 170431 - protein, 63 aa, Heterodera glycines
  Coding regions on vcDNA: vcDNA=SeqID_96854; Strand=-; Position=64-255
KKNSVYHSAGNKINSIPVKNQRSQILRNYSIPLSQAQNAIIRLAHEAYFSFCRESCRESTVSS

SEQ ID NO: 170432 - protein, 89 aa, Heterodera glycines
  misc_feature (23)..(23): Xaa can be any naturally occurring amino acid
  Homolog annotation: Hit_ID=CAE66848.1; Match level="QueryCoverage =95%, HitCoverage=45%, E-value=6e-13, Identity=44%"; Hit description =Hypothetical protein CBG12220 [Caenorhabditis briggsae]
  Coding regions on vcDNA: vcDNA=SeqID_96855; Strand=+; Position=2-269
KFCKQARKCGMRNYIEHFVTKIXTENPYCAIYVVPGRNATPVLRAEYSNGRLVHVNAKAFSTERVCLHMNNLRTRSGIPIYKFENSHFS

SEQ ID NO: 170433 - protein, 103 aa, Heterodera glycines
  Coding regions on vcDNA: vcDNA=SeqID_96856; Strand=-; Position=1-309
KMYKCHSFILHSLFHFFPSLFLSFPHFPIALHSFTAFFPHSAHFGAAGFLHSFLHLPLAHFTQSVAHLLFVFGHTLLHSSMIKLASLKEFNATTKIRQKRRKA

SEQ ID NO: 170434 - protein, 76 aa, Heterodera glycines
  Homolog annotation: Hit_ID=CAE65012.1; Match level="QueryCoverage =81%, HitCoverage=33%, E-value=2e-12, Identity=61%"; Hit description =Hypothetical protein CBG09850 [Caenorhabditis briggsae]
  Coding regions on vcDNA: vcDNA=SeqID_96857; Strand=+; Position=42-272
MTLRNDTPMPPDEELRVPHEISLSSPWLRAVAVYMGIACEKEAKEFMLLRSERDNDPNQFKKYRNNFVFDAFNPTG

SEQ ID NO: 170435 - protein, 116 aa, Heterodera glycines
  Homolog annotation: Hit_ID=CAE72800.1; Match level="QueryCoverage =95%, HitCoverage=96%, E-value=2e-15, Identity=32%"; Hit description =Hypothetical protein CBG20077 [Caenorhabditis briggsae]
  Coding regions on vcDNA: vcDNA=SeqID_96858; Strand=+; Position=1-351
MPKMDMTFHFRTSEFILLREWLPQSIFAYLFSLLAVLALSVAYELLRVFRAILFQSLLHFIQFFLGFSLMLVAMTYNVPIFVALLLGHSIGYFLTAPLYRHGLAEENRTGGDCCCS

SEQ ID NO: 170436 - protein, 146 aa, Heterodera glycines
  misc_feature (112)..(112): Xaa can be any naturally occurring amino acid
  Homolog annotation: Hit_ID=AAB02657.1; Match level="QueryCoverage =100%, HitCoverage=27%, E-value=2e-19, Identity=38%"; Hit description= cytochrome P450 CYP3A24 sp|Q29496|CP3O_SHEEP Cytochrome P450 3A24 (CYPIIIA24)
  Gene Ontology: Mol. function=cytochrome P450 activity; Cellular component=microsome; Biological process=steroid metabolism
  Coding regions on vcDNA: vcDNA=SeqID_96859; Strand=+; Position=2-439
VGVPGPNTNILFGNTLKQFRTGVIEVDEEMFKKYGNSYGSFVFERREFCTKDPKMLRQMFIKEFSHFQNRYNAIPEREHAPKSLMRNILTVLRDDDWRRVRNRITPAFTTGXLKKLIPILCEGTEKLCKVLETENALKGKEVPLKE

SEQ ID NO: 170437 - protein, 98 aa, Heterodera glycines; identical to SEQ ID NO: 168355
  Homolog annotation: Hit_ID=CAF94886.1; Match level="QueryCoverage =97%, HitCoverage=87%, E-value=2e-39, Identity=66%"; Hit description =unnamed protein product [Tetraodon nigroviridis]
  Gene Ontology: Mol. function=protein binding; Cellular component =ubiquitin ligase complex; Biological process=protein modification
  Coding regions on vcDNA: vcDNA=SeqID_96860; Strand=+; Position=29-325

SEQ ID NO: 170438 - protein, 174 aa, Heterodera glycines
  Homolog annotation: Hit_ID=XP_316726.1; Match level="QueryCoverage =91%, HitCoverage=59%, E-value=4e-20, Identity=35%"; Hit description =ENSANGP00000020947 [Anopheles gambiae]
  Gene Ontology: Mol. function=signal recognition particle binding; Cellular component=integral to endoplasmic reticulum membrane; Biological process=protein-ER targeting
  Coding regions on vcDNA: vcDNA=SeqID_96861; Strand=+; Position=2-523
SSQLVAADHHPLILPALITFVILLVSSVFFFIYRRFRQKPNIILFVGLSGSGKTTLFTKLINSKNCWDSFISLKENQFDSYATDNGQTLTLLDFPGSDSFKKTLCRKWLNEKRNSLKGVVFVLDSATFSKKDAAELLYDVLFESGNAVPVLIACNKQDIGHAKSHSLIKKALEN

SEQ ID NO: 170439 - protein, 77 aa, Heterodera glycines; identical to SEQ ID NO: 168354
  Coding regions on vcDNA: vcDNA=SeqID_96862; Strand=+; Position=2-235

SEQ ID NO: 170440 - protein, 93 aa, Heterodera glycines; identical to SEQ ID NO: 163960
  Coding regions on vcDNA: vcDNA=SeqID_96863; Strand=+; Position=10-291

SEQ ID NO: 170441 - protein, 111 aa, Heterodera glycines; identical to SEQ ID NO: 162343
  Homolog annotation: Hit_ID=NP_647792.1; Match level="QueryCoverage =97%, HitCoverage=99%, E-value=6e-31, Identity=58%"; Hit description =CG17737-PA [Drosophila melanogaster] gb|AAR10187.1| similar to Drosophila melanogaster CG17737 [Drosophil
  Gene Ontology: Mol. function=translation initiation factor activity; Cellular component=ribosome; Biological process=translational initiation
  Coding regions on vcDNA: vcDNA=SeqID_96864; Strand=+; Position=11-346

SEQ ID NO: 170442 - protein, 94 aa, Heterodera glycines
  Homolog annotation: Hit_ID=CAE74012.1; Match level="QueryCoverage =73%, HitCoverage=59%, E-value=2e-09, Identity=46%"; Hit description =Hypothetical protein CBG21660 [Caenorhabditis briggsae]
  Coding regions on vcDNA: vcDNA=SeqID_96865; Strand=+; Position=12-296
MNQIKVDQEESTKLWDWPLQSHDELVSIYDGRDRWEVGLDTGFFTPNEIEVNAKCNVLTILERHLVHIVAAVVQLLIPVGMEQIQIHVEKIVKK

SEQ ID NO: 170443 - protein, 145 aa, Heterodera glycines
  misc_feature (84)..(84): Xaa can be any naturally occurring amino acid
  Homolog annotation: Hit_ID=XP_314537.1; Match level="QueryCoverage =87%, HitCoverage=45%, E-value=2e-18, Identity=37%"; Hit description =ENSANGP00000016990 [Anopheles gambiae]
  Coding regions on vcDNA: vcDNA=SeqID_96866; Strand=+; Position=32-466
MPSSSGSEKGNGRNGVRGERRRYYIDLRENRRGSFLRITQLETHSGIRNSVALPFEGIGQLHDALDSILEEYGEGFIEEEAELXHSQMIRADGKSFFFDPDHNSRGDFLKITELKSFMGVRNCGVLSVRAIPECAQRLVELYNDY

SEQ ID NO: 170444 - protein, 147 aa, Heterodera glycines; identical to SEQ ID NO: 168350
  Homolog annotation: Hit_ID=XP_392405.1; Match level="QueryCoverage =46%, HitCoverage=31%, E-value=2e-09, Identity=40%"; Hit description =similar to CG14207-PB [Apis mellifera]
  Coding regions on vcDNA: vcDNA=SeqID_96867; Strand=+; Position=19-462

SEQ ID NO: 170445 - protein, 164 aa, Heterodera glycines
  Homolog annotation: Hit_ID=NP_497949.1; Match level="QueryCoverage =68%, HitCoverage=31%, E-value=2e-34, Identity=56%"; Hit description =protein phosphatase 2C, possibly N-myristoylated (39.1 kD) (3F743) [Caenorhabditis elegans] emb|CAA86456.
  Gene Ontology: Mol. function=protein phosphatase type 2C activity; Biological process=cell cycle
  Coding regions on vcDNA: vcDNA=SeqID_96868; Strand=+; Position=37-528
MGQALSEPITTKNSASCSNDRYFVGSSSMQGWRISMEDAHTHLLELPEDPSTAFFAVFDGHGGAQIAKYASENLHTQIAQSNTFREGRISDALVEAFLELDEQMMASEQISEQGGNDGAAGGWTSAEVGGEATERHRAKSWCGRYHRGCPCPSFTRWRRGIYAT

SEQ ID NO: 170446 - protein, 147 aa, Heterodera glycines; identical to SEQ ID NO: 168342
  Homolog annotation: Hit_ID=EAL17339.1; Match level="QueryCoverage =67%, HitCoverage=25%, E-value=2e-15, Identity=43%"; Hit description =hypothetical protein CNBN1650 [Cryptococcus neoformans var. neoformans B-3501A]
  Gene Ontology: Mol. function=protein binding; Cellular component =filopodium; Biological process=signal transduction
  Coding regions on vcDNA: vcDNA=SeqID_96869; Strand=+; Position=21-464

SEQ ID NO: 170447 - protein, 119 aa, Heterodera glycines; identical to SEQ ID NO: 168341
  Coding regions on vcDNA: vcDNA=SeqID_96870; Strand=+; Position=1-360

SEQ ID NO: 170448 - protein, 160 aa, Heterodera glycines
  Homolog annotation: Hit_ID=NP_496216.1; Match level="QueryCoverage =90%, HitCoverage=91%, E-value=6e-28, Identity=41%"; Hit description =surfeit 5 (18.1 kD) (2K591) [Caenorhabditis elegans] emb|CAA88887.1| Hypothetical protein ZK970.3 [Caenor
  Gene Ontology: Cellular component=cytoplasm
  Coding regions on vcDNA: vcDNA=SeqID_96871; Strand=+; Position=10-489
MAARSNTNKETLKNHQTSKTIATKKLVVQDYKNRLKDGIKSLNDNFECILGASKVNCDDATHRSNSAGKLGEHYAIRNEAIARAALLVKATNELKMLTNEIREFLTIRDFNFISNSISKAEEDFKKRLKQYENDYSALRMSISTMASEIDRELVENSLYR

SEQ ID NO: 170449 - protein, 92 aa, Heterodera glycines
  Homolog annotation: Hit_ID=CAE65180.1; Match level="QueryCoverage =89%, HitCoverage=82%, E-value=6e-11, Identity=42%"; Hit description =Hypothetical protein CBG10053 [Caenorhabditis briggsae]
  Coding regions on vcDNA: vcDNA=SeqID_96872; Strand=+; Position=24-302
MFGRQFHIVMADNSVAVLKYKRVPNRRILDFYHTEVPPDFRGQGFAEQLVRAGFRHCLDTRFSVYPSCTYVQKYIRDLATEEEKKIVVEKYY

SEQ ID NO: 170450 - protein, 121 aa, Heterodera glycines; identical to SEQ ID NO: 164393
  Homolog annotation: Hit_ID=NP_495281.1; Match level="QueryCoverage =86%, HitCoverage=94%, E-value=8e-40, Identity=68%"; Hit description =putative protein of eukaryotic origin (2G650) [Caenorhabditis elegans] gb|AAA68261.1| Hypothetical protei
  Coding regions on vcDNA: vcDNA=SeqID_96873; Strand=+; Position=2-367

SEQ ID NO: 170451 - protein, 47 aa, Heterodera glycines
  Coding regions on vcDNA: vcDNA=SeqID_96874; Strand=+; Position=3-146
VTQKRSADRPPPIIKNRFQTNHQIIPSIHTHSHLSIILYAKVTKLRN

SEQ ID NO: 170452 - protein, 116 aa, Heterodera glycines
  Coding regions on vcDNA: vcDNA=SeqID_96875; Strand=+; Position=3-353
RGSRLGPLSNDYVLCRVQAFRNYAIKKERPPPAKIQVPPPANETGHWKYERDYSYDLRYSNPINKYSSFTRFITLTATGHKELWALFALLMLSSSLAIGIVFYSLGKIEVWVDRST

SEQ ID NO: 170453 - protein, 67 aa, Heterodera glycines
  Homolog annotation: Hit_ID=EAA58315.1; Match level="QueryCoverage =76%, HitCoverage=30%, E-value=1e-09, Identity=50%"; Hit description =hypothetical protein AN5806.2 [Aspergillus nidulans FGSC A4] ref|XP _409943.1| hypothetical protein AN5806.
  Coding regions on vcDNA: vcDNA=SeqID_96876; Strand=+; Position=3-206
PIKIVPIGGNRFISVDRFKGRILIGIREYYQKDGKWLPGKKGISLNQDQFNGLLKILPDVKKMISSA

SEQ ID NO: 170454 - protein, 98 aa, Heterodera glycines; identical to SEQ ID NO: 168326
  Coding regions on vcDNA: vcDNA=SeqID_96877; Strand=+; Position=1-297

SEQ ID NO: 170455 - protein, 231 aa, Heterodera glycines
  misc_feature (201)..(201): Xaa can be any naturally occurring amino acid
  Homolog annotation: Hit_ID=NP_508515.1; Match level="QueryCoverage =91%, HitCoverage=69%, E-value=2e-41, Identity=42%"; Hit description =MIP family (XD645) [Caenorhabditis elegans] pir||T16635 hypothetical protein M02F4.8 - Caenorhabditis ele
  Gene Ontology: Mol. function=water channel activity; Cellular component=integral to plasma membrane; Biological process=transport
  Coding regions on vcDNA: vcDNA=SeqID_96878; Strand=+; Position=63-757
MSMNSLNMGKEVAKRWMGINNRRMAPFSLSPVDRMRQSVFRVRSRLAVNLLSEGLATFLLLLVGNGIGAQHILGGGKLDNYMQVCFGWGMLIALLVFATYHTSGGHLNPAVSLAFVSLGKLPFAHFLLYSLVQTVGAFFGSALCFHVYRESFEKFDAGIRTVGGPSGTGAIFCSFPDEHIGHLPAFVDEIVGTGLLLLFAXALIGPANQPPKWVPPIRFGVAIVPTTPSFG

SEQ ID NO: 170456 - protein, 54 aa, Heterodera glycines; identical to SEQ ID NO: 164391
  Coding regions on vcDNA: vcDNA=SeqID_96879; Strand=+; Position=21-185

SEQ ID NO: 170457 - protein, 138 aa, Heterodera glycines
  Homolog annotation: Hit_ID=CAE65087.1; Match level="QueryCoverage =78%, HitCoverage=73%, E-value=4e-10, Identity=36%"; Hit description =Hypothetical protein CBG09945 [Caenorhabditis briggsae]
  Coding regions on vcDNA: vcDNA=SeqID_96880; Strand=+; Position=12-428
MRLGILLFVFRISLNLIAKTNATYFYVRGELWCQGEPYVGAKIFLMEADTLDPDDLLGEERSAPDGRFEVRGGESEIGDEEPYLMVGHTCPQRGVPPDPACHFLTRVDLPNFLTHIEVPPIHLDGQYEFQHICGEDDV

SEQ ID NO: 170458 - protein, 263 aa, Heterodera glycines
  Homolog annotation: Hit_ID=XP_395784.1; Match level="QueryCoverage =82%, HitCoverage=56%, E-value=1e-68, Identity=59%"; Hit description =similar to SD03319p [Apis mellifera]
  Gene Ontology: Mol. function=receptor binding; Cellular component =mitochondrion; Biological process=proteolysis and peptidolysis
  Coding regions on vcDNA: vcDNA=SeqID_96881; Strand=+; Position=8-796
RWKIHTILHFVPHQYAWVVERAGKFHRILEPGVHIVYPLIDEIRYRHCLKEMCIEIPQQEAITKDNVQLDLDAILYVQVVDPYKASYGVQEPEYAISQLAQTVMRAEVGKLMLDNVFHERANLNRAIVGGIKESCAPWGLICLRYEIRTMNMPPEIRRAMKMQVEAERKKRAAILESEGICEAEKNRAEGEKQARILRSEAQMQEQMNKSMGLAKAAEAEKIQRILQSEAEMQMKVNMAIGLAKSAESEKESRVILAEAEEQE

SEQ ID NO: 170459 - protein, 219 aa, Heterodera glycines
  misc_feature (204)..(204): Xaa can be any naturally occurring amino acid
  Homolog annotation: Hit_ID=CAD38523.1; Match level="QueryCoverage =100%, HitCoverage=87%, E-value=1e-86, Identity=66%"; Hit description= secreted glutathione peroxidase [Globodera rostochiensis]
  Gene Ontology: Mol. function=electron transporter activity; Cellular component=extracellular space; Biological process=lipid metabolism
  Coding regions on vcDNA: vcDNA=SeqID_96882; Strand=+; Position=18-674
MKNFLTFLAFFLIVPCFKADNEKNKAAPRVFAEHPGPKLVDETTRWSKCQADQNLTIYDFEVETLDGKFTNLEKYKGQIVLLINVATFCAFTQQYLDFNPMLERNRANGVPLTILAFPCNQFHLQEPAENHEILNGVMHVRPGDGWKPHSNLHIHGKLEVNGANAHPLFDFLRDSCPQTVPVLGIKESMFYNPITVSDITWDFXKFLIDANGVPRFRIH

SEQ ID NO: 170460 - protein, 107 aa, Heterodera glycines
  Coding regions on vcDNA: vcDNA=SeqID_96883; Strand=+; Position=3-326
CRVRPFLCSSHFYGVPHLKFVSFHPSPRRLSAAIGPLFGLCAGESGAKFDEKFSKMSKMSGDGGHSTARQMPSGCNLPTVPMGFGPGKMVCVKRKRTRQSRTDGRGR

SEQ ID NO: 170461 - protein, 37 aa, Heterodera glycines
  Coding regions on vcDNA: vcDNA=SeqID_96884; Strand=-; Position=1-111
ARVQCPKPCPPPPFLQNKREFDYGTNEPTIGTTNSTK

SEQ ID NO: 170462 - protein, 176 aa, Heterodera glycines
  Homolog annotation: Hit_ID=CAE74104.1; Match level="QueryCoverage =78%, HitCoverage=62%, E-value=7e-37, Identity=50%"; Hit description =Hypothetical protein CBG21764 [Caenorhabditis briggsae]
  Gene Ontology: Mol. function=ligase activity; Biological process =coenzymes and prosthetic group metabolism
  Coding regions on vcDNA: vcDNA=SeqID_96885; Strand=+; Position=20-550
MGSSAFPPFCLFYKCSGLRVQEFLLRRMTDDKAFNGHFLCLLEHPPTYTVGIRQDEYSDEFAQRLRLLGAEFHRIKRGGLVTFHGPGQLIVYPVFNLRKLSADGKMNGIGVKRFVELVEETVIQTLECDFGMNGIGRTQNPGVWVGENRKVAAIGIQIRHGITSHGLALNCDTDLG

SEQ ID NO: 170463 - protein, 90 aa, Heterodera glycines; identical to SEQ ID NO: 168310
  Homolog annotation: Hit_ID=XP_311435.1; Match level="QueryCoverage =100%, HitCoverage=91%, E-value=6e-16, Identity=42%"; Hit description= ENSANGP00000018599 [Anopheles gambiae]
  Gene Ontology: Biological process=positive regulation of growth rate
  Coding regions on vcDNA: vcDNA=SeqID_96886; Strand=+; Position=3-275

SEQ ID NO: 170464 - protein, 72 aa, Heterodera glycines; identical to SEQ ID NO: 168309
  Coding regions on vcDNA: vcDNA=SeqID_96887; Strand=+; Position=1-219

SEQ ID NO: 170465 - protein, 165 aa, Heterodera glycines
  Homolog annotation: Hit_ID=AAS78778.1; Match level="QueryCoverage =83%, HitCoverage=89%, E-value=5e-26, Identity=45%"; Hit description =thioredoxin [Ascaris suum]
  Gene Ontology: Mol. function=thioredoxin reductase (NADPH) activity; Cellular component=nucleus
  Coding regions on vcDNA: vcDNA=SeqID_96888; Strand=+; Position=2-499
IHPFWNIGVLRTSDDKSLMNGQLALKGCEIMALYFGAHMCQRCREFIPVLKQFYDQLKKSPETMPFEIVFVPFDRSEDEFRNSLRDLHDDWLYIPYGSVHINSLAARFNIINWGVIPTLVVLKEDGTLITMAGQANVQHLSASEAMVRWRSIPNPESGFKDFSKF

SEQ ID NO: 170466 - protein, 116 aa, Heterodera glycines
  Coding regions on vcDNA: vcDNA=SeqID_96889; Strand=-; Position=62-412
MFINAAQLKRSASSSDWLTKMYRGGGAMAWMVTKKLCKSGNICCNSVHRSRYGIVTHNWCCCCGICCCSHWRSTVVAAWLRSSVPCNFDGKTICTKVMRNSKSFIGATTTKKLFRQ

SEQ ID NO: 170467 - protein, 150 aa, Heterodera glycines
  Coding regions on vcDNA: vcDNA=SeqID_96890; Strand=+; Position=59-511
MDGRQKKLKTVDFEILTREQLCVLCQAVLNKWKGQANKNEQHFREEILDSCSLIENPSEAKKCRDGVTDAKVARLRKEGTEEMCVAEGFCGKGEMKELEKKMERMEKRIDDRKQKFEKGLRIIPPVDLSPVKSVPGDKATNTTNRTMGGG

SEQ ID NO: 170468 - protein, 88 aa, Heterodera glycines
  misc_feature (88)..(88): Xaa can be any naturally occurring amino acid
  Coding regions on vcDNA: vcDNA=SeqID_96891; Strand=+; Position=2-268
YRFARRGTHLGARLQVRRVQTAEFAKIARIRPVALIQSSDAEYGRHFWPKCAIQSVLPLAFERAISHVMLCNLIFCFKKFCLHSLNIX

SEQ ID NO: 170469 - protein, 102 aa, Heterodera glycines
  Coding regions on vcDNA: vcDNA=SeqID_96892; Strand=+; Position=3-311
TDYFDLLKCLDFIILTRTNLTGLNSRAGRCAVCEMDKVSLSCQLACRSALFSPTLSRNKKQKRIEMVCHWGHGDEIRGDRGVLNCLKSTHHWLAQKHQQLNN

SEQ ID NO: 170470 - protein, 70 aa, Heterodera glycines
  Coding regions on vcDNA: vcDNA=SeqID_96893; Strand=-; Position=0-209
AQLLTMQSKKHINNVREQMIYTELNSSLKMRAAQIPTQKPRALFTKDFPGGGRYEGALGPGLMAPAGLTA

SEQ ID NO: 170471 - protein, 48 aa, Heterodera glycines
  Coding regions on vcDNA: vcDNA=SeqID_96894; Strand=-; Position=1-144
SIFYCDYFFFKIFILTFPFCHQFTPKVSLANFHCLFHVFRLCCVICDH

SEQ ID NO: 170472 - protein, 148 aa, Heterodera glycines
  misc_feature (1)..(1): Xaa can be any naturally occurring amino acid
  Coding regions on vcDNA: vcDNA=SeqID_96895; Strand=-; Position=64-510
XFHKIAPNNADFSVSPITLVHSFTHSSISSIGVLHFALNLFLGQNFDHFALAGDHFFATIDGKSNFETAIGCNKHVELLLAIHRQMFVLHHPQTVHKLIIQLINSNLNIVSPAKHFGTSKNRHINCLAIGTVNVAQKVGLPRERFRSE

SEQ ID NO: 170473 - protein, 86 aa, Heterodera glycines
  Homolog annotation: Hit_ID=AAP30770.1; Match level="QueryCoverage =56%, HitCoverage=18%, E-value=7e-12, Identity=65%"; Hit description =putative gland protein G17G01 [Heterodera glycines]
  Coding regions on vcDNA: vcDNA=SeqID_96896; Strand=+; Position=2-262
FASVIGWGYSAVHSFNLLFYWTDFWTCVNFQADHTIVPLITFVLSLVLACSSIFEIVLHKFVLNDVDTESDNMGIHQKQKNGCAFV

SEQ ID NO: 170474 - protein, 133 aa, Heterodera glycines; identical to SEQ ID NO: 152027
  Coding regions on vcDNA: vcDNA=SeqID_96897; Strand=+; Position=8-409

SEQ ID NO: 170475 - protein, 98 aa, Heterodera glycines
  Coding regions on vcDNA: vcDNA=SeqID_96898; Strand=-; Position=2-295
GFAKGTDGTAKMHSMICCVVHRPPLARFARVNIMCGASPTSTASTFDRSTATESEWHWHSRVPRRITPLQKQSHYNLMVSLRYDMSEYLPHSISWGGG

SEQ ID NO: 170476 - protein, 56 aa, Heterodera glycines
  Coding regions on vcDNA: vcDNA=SeqID_96899; Strand=+; Position=3-173
SFLNRRGRSSSSNTKRDLARKDHFFPHKFLIFCGVSNLEDRIFFIICGPKSRNFTQ

SEQ ID NO: 170477 - protein, 146 aa, Heterodera glycines; identical to SEQ ID NO: 164346
  Coding regions on vcDNA: vcDNA=SeqID_96900; Strand=+; Position=47-487

SEQ ID NO: 170478 - protein, 93 aa, Heterodera glycines
  Coding regions on vcDNA: vcDNA=SeqID_96901; Strand=-; Position=2-280
ASPSTIIIINQMPQSERHSFGLKSARAQIFAFGQMGDSAGVFQPKLLQHIRRFTDADILFVFDQFTNRCLANRRPFGAHQFEQKATVLHVCNK

SEQ ID NO: 170479 - protein, 179 aa, Heterodera glycines
  misc_feature (13)..(13): Xaa can be any naturally occurring amino acid
  Homolog annotation: Hit_ID=NP_501684.1; Match level="QueryCoverage =97%, HitCoverage=72%, E-value=2e-53, Identity=58%"; Hit description =glyoxalase II (26.4 kD) (4K272) [Caenorhabditis elegans] emb|CAA92800.1| Hypothetical protein C33A12.7 [C
  Gene Ontology: Biological process=sulfur metabolism
  Coding regions on vcDNA: vcDNA=SeqID_96902; Strand=+; Position=42-580
LFRQLFEAKSFTXSYLLGCTKTRQALVIDPVIETVERDASLVHELGLDLKYVVNTHIHADHVTGSGELKRNKYFPKAISILSGKAGGRADLLVKHSDLIRWGDGLELEVRETPGHTNGCVTFVCHSNQMAFTGDALLIRGCGRTDFQHGNARTLFRSVKSQIFTLPPDYLIYPAHGKLN

SEQ ID NO: 170480 - protein, 126 aa, Heterodera glycines
  Coding regions on vcDNA: vcDNA=SeqID_96903; Strand=+; Position=15-395
MNIFTFIFIALLCQYHRSKHHINAGPLDAEKSPSNGEGIHKYEAEKLKIGEVAKLNHGETKTEMDEADGHRHSLPKDRGDIVHPKSQDGVCKIHEDVKLDFNDDIFGQHVSGEERPPVAEPMPMSA

SEQ ID NO: 170481 - protein, 53 aa, Heterodera glycines; identical to SEQ ID NO: 164219
  Coding regions on vcDNA: vcDNA=SeqID_96904; Strand=+; Position=19-180

SEQ ID NO: 170482 - protein, 112 aa, Heterodera glycines; identical to SEQ ID NO: 164356
  Coding regions on vcDNA: vcDNA=SeqID_96905; Strand=+; Position=33-371

SEQ ID NO: 170483 - protein, 36 aa, Heterodera glycines
  Coding regions on vcDNA: vcDNA=SeqID_96906; Strand=+; Position=1-108
VPYSSSVRGFLRFFGQFSPRCAGSKKKKKNSRLVLS

SEQ ID NO: 170484 - protein, 166 aa, Heterodera glycines; identical to SEQ ID NO: 161714
  Coding regions on vcDNA: vcDNA=SeqID_96907; Strand=-; Position=31-531

SEQ ID NO: 170485 - protein, 71 aa, Heterodera glycines
  Homolog annotation: Hit_ID=XP_316230.1; Match level="QueryCoverage =66%, HitCoverage=6%, E-value=5e-14, Identity=68%"; Hit description =ENSANGP00000017684 [Anopheles gambiae]
  Coding regions on vcDNA: vcDNA=SeqID_96908; Strand=+; Position=131-346
GWRTHQEDAHNCILSFGDECSFFAVYDGHGGSDVSSYLKKNFPDFLKEHNLLLHTTDGRSQRGIAQIICEI

SEQ ID NO: 170486 - protein, 153 aa, Heterodera glycines
  Homolog annotation: Hit_ID=CAC83611.1; Match level="QueryCoverage =78%, HitCoverage=44%, E-value=3e-56, Identity=81%"; Hit description =EXPB1 protein [Globodera rostochiensis]
  Coding regions on vcDNA: vcDNA=SeqID_96909; Strand=+; Position=59-517
MAKSIGKQSKASNSKSTPNQSKSNQPPSSPSSSSSSCMGCLSNTNTAGPIDSYLGKPVKNSIFTFYGAGGRGACGLDAGVPKMSAAGSGQLFKSDGQWKDACRADKQYMLDDPICKNICIKVDYNGKTLTVPINNKCPECPPNHVDLSIDAFN

SEQ ID NO: 170487 - protein, 151 aa, Heterodera glycines
  Homolog annotation: Hit_ID=CAC83611.1; Match level="QueryCoverage =76%, HitCoverage=42%, E-value=1e-53, Identity=81%"; Hit description =EXPB1 protein [Globodera rostochiensis]
  Coding regions on vcDNA: vcDNA=SeqID_96910; Strand=+; Position=57-509
MAKSSGKQSKASNSKSKPKPNQSKSNKPPSSPSSSSSSCMGCLSNTKTAGPIDSYLGKPVKNSIFTFYGAGGRGACGLNAGVPKMSAAGSGQLFKSDGQWKDACRADKQYMLDDPICKNICIKVDYNGKTLTVPINNKCPECPPNHVDLSI

SEQ ID NO: 170488 - protein, 82 aa, Heterodera glycines; identical to SEQ ID NO: 163783
  Homolog annotation: Hit_ID=NP_501187.1; Match level="QueryCoverage =100%, HitCoverage=97%, E-value=4e-37, Identity=76%"; Hit description= cysteine-rich protein 1 (4I208) [Caenorhabditis elegans] gb|AAK18878.1| Hypothetical protein B0496.7 [Ca
  Gene Ontology: Cellular component=nucleus; Biological process =myogenesis
  Coding regions on vcDNA: vcDNA=SeqID_96911; Strand=+; Position=91-339

SEQ ID NO: 170489 - protein, 101 aa, Heterodera glycines
  Homolog annotation: Hit_ID=CAI17295.1; Match level="QueryCoverage =96%, HitCoverage=46%, E-value=2e-15, Identity=45%"; Hit description =phospholysine phosphohistidine inorganic pyrophosphate phosphatase [Homo sapiens] emb|CAH70377.1| phosphol
  Coding regions on vcDNA: vcDNA=SeqID_96912; Strand=+; Position=3-308
RIRGFLVDINGVLFDTSLDGGKAIPGSIEAVKRLYELSCVRFVSNESSGTRGAICQKLHRLGFVGPQPEHIFTPAPVAVKYLRQHGLRPKLIVHKGLKVGL

SEQ ID NO: 170490 - protein, 80 aa, Heterodera glycines
  Coding regions on vcDNA: vcDNA=SeqID_96913; Strand=-; Position=50-292
ILLIGVLICIFIVKSFQFKLFLFPGLHVLVLINSDRDAHNVSIFDQTEGRRWTVPLGGDAIVTAIWKPKNDGGKAAKNAQ

SEQ ID NO: 170491 - protein, 73 aa, Heterodera glycines
  Coding regions on vcDNA: vcDNA=SeqID_96914; Strand=+; Position=2-220
RDFYSIGAKRGMQMGTISANHDSSVKFELISSDLSLFPIEFICCPIPILLNCLAQLPLSNMKKSSFGQSVNFG

SEQ ID NO: 170492 - protein, 124 aa, Heterodera glycines
  Coding regions on vcDNA: vcDNA=SeqID_96915; Strand=+; Position=29-403
MSSNGIITIVALFLVLFGTHITTQIGAMNRHRQQRSLGHPFTVDKQQHTAQNENLVGAYLSRGMFSCGAKYVGTLQRLKRIIEEVHADYSECQKSMKQMDENEQMAFGKGHGTERFAVIDELIN

SEQ ID NO: 170493 - protein, 88 aa, Heterodera glycines
  Coding regions on vcDNA: vcDNA=SeqID_96916; Strand=-; Position=1-264
FVILPQIVPLGSIDQFVNHRKSLCAVPFSECHLLVLVHLLHRFLAFRIVGMHFLNDSFQSLQCANIFGAAAEHSPRQIGAEQIFVLCS

SEQ ID NO: 170494 - protein, 221 aa, Heterodera glycines
  Homolog annotation: Hit_ID=NP_492041.1; Match level="QueryCoverage =98%, HitCoverage=36%, E-value=7e-29, Identity=33%"; Hit description =bromodomain containing 7 (71.3 kD) (1H803) [Caenorhabditis elegans] emb|CAA95779.1| Hypothetical protein
  Coding regions on vcDNA: vcDNA=SeqID_96917; Strand=+; Position=3-665
KYYFSEKYLLFLVYSLPFGKALTEEQLGIRLRRKEEQTPRQLKEKSGRERPLPFLSDSQKTEEILNTAPVKIKDRLTGRRPCQIAYLDNREGAFALNVLTETATTKLTLGDHVKPLGKGNPGICAPFEPRICSDYLVSYTNPGPFASFAPHFDLTWATMSKRDSDLLLSCYGDRDNVTDATALRQMDSNVGTPTSDVGESMVNDLTDHEHLGTITSLGNTS

SEQ ID NO: 170495 - protein, 54 aa, Heterodera glycines
  Coding regions on vcDNA: vcDNA=SeqID_96918; Strand=-; Position=2-163
VIKGQSIQNKRSPSASNIPYNGHNCPTLELRHKTNGTPTSNPGTSLGSISQRHV

SEQ ID NO: 170496 - protein, 115 aa, Heterodera glycines
  Coding regions on vcDNA: vcDNA=SeqID_96919; Strand=+; Position=3-347
LFRFHVGRLRWWLLRRLWLRWVLRFTDHFGRRSADRRLSLSHLRCRRPLAALFKTTERKGRSAATTAVLPPILHSQRRTIRNQRIEHRISLKMALISRHNWHFNRTNEGAKKLKI

SEQ ID NO: 170497 - protein, 120 aa, Heterodera glycines
  Coding regions on vcDNA: vcDNA=SeqID_96920; Strand=+; Position=324-683
RNLWFSNNRNIKNSPLFHSHNNNYIVIEQLICPVVFPPRPLFSHPLHSFGRSSIWPIIRAVVASIWRPFPLLIVSFGTVHLCPHGTSIVFGFTTRPHFDDHFICSASCCSISNWPIRWPN

SEQ ID NO: 170498 - protein, 51 aa, Heterodera glycines
  Coding regions on vcDNA: vcDNA=SeqID_96921; Strand=+; Position=2-154
MNFYIIFFLVIFSTFFCQLLIVGATEKSGGVQCDEANGMEPFEYIPALWRE

SEQ ID NO: 170499 - protein, 57 aa, Heterodera glycines
  Coding regions on vcDNA: vcDNA=SeqID_96922; Strand=+; Position=81-251
MPALNGGDELLLRKKRQDEGDEAEENAGGENAENGNEENNGEGQNEENNNGEENNEE

SEQ ID NO: 170500 - protein, 48 aa, Heterodera glycines; identical to SEQ ID NO: 168261
  Coding regions on vcDNA: vcDNA=SeqID_96923; Strand=+; Position=1-147

SEQ ID NO: 170501 - protein, 118 aa, Heterodera glycines
  Coding regions on vcDNA: vcDNA=SeqID_96924; Strand=-; Position=0-353
KIHGFSGSGLAQNSRSNDKFRFKDSICLAINLFLSIKESLTYALLSAGLMLCADVTILAHISHRNFLHMDSDETLLLQWHVVPSTDPLLIGTIFAALILCSVVYLVDVWVVYRQRRWR

SEQ ID NO: 170502 - protein, 174 aa, Heterodera glycines
  Homolog annotation: Hit_ID=NP_508412.1; Match level="QueryCoverage =94%, HitCoverage=35%, E-value=2e-54, Identity=61%"; Hit description =vacuolar atp synthase (54.2 kD) (XC857) [Caenorhabditis elegans] gb|AAA91266.1| Vacuolar h atpase protein
  Coding regions on vcDNA: vcDNA=SeqID_96925; Strand=+; Position=1-522
VDVGEIAAGHHVTPVDMTTATSKLQLEAAEVRNPANKPNWSSYLRSQLVPQNEYNFIIELEKAKNKQERDEALAKDKTNSARSIINLITEVAKDQLIRYVLTLFDDLLQEDKSRVEIFHDYARRQKRTIWSWFQGILTRNDSFIVNQMSAIFSKLACYGSVLMDGQELQAYFNF

SEQ ID NO: 170503 - protein, 115 aa, Heterodera glycines
  Coding regions on vcDNA: vcDNA=SeqID_96926; Strand=+; Position=171-515
MTGTTSATSSTNNTINTNNNNNNGNSTCVKGSSTTHTVTAPPSDISLTERMKHLLNTGNDADVHFLVGSDDKKELLPAHKLILKTASNVFEAMFRFDTENLKASGKDPHSEIKPV

SEQ ID NO: 170504 - protein, 73 aa, Heterodera glycines; identical to SEQ ID NO: 164437
  Coding regions on vcDNA: vcDNA=SeqID_96927; Strand=+; Position=169-390

SEQ ID NO: 170505 - protein, 58 aa, Heterodera glycines
  Coding regions on vcDNA: vcDNA=SeqID_96928; Strand=+; Position=89-262
MARHKNILRIHLIILSFANANASFLSLKVHFLLICPFFSFFCHYYFFETKNFNKILNR

SEQ ID NO: 170506 - protein, 90 aa, Heterodera glycines
  Coding regions on vcDNA: vcDNA=SeqID_96929; Strand=+; Position=2-274
DFLNIFNSHRSLKWPVNVPAAKTTNVVPLTAAEILVHHANAPTASAKSKRDSANPRGRDAVLREANGKDGERGEGEAERERGRERKKGPQ

SEQ ID NO: 170507 - protein, 153 aa, Heterodera glycines
  Coding regions on vcDNA: vcDNA=SeqID_96930; Strand=+; Position=48-509
LLQSFTHIFLMSFPCGDGWRQQIHPEEQLPQYEQKCDIEMQLDTLKQTVKANTKACAESAQRIEDLQSFRFYYLILAFFAFFILIMSAMFLYTRISLLSDRIYTQIGNVDNRIRDHLDTKSERLYAKIDALSAQVQRLGLAMATLSNGSHTTT

SEQ ID NO: 170508 - protein, 137 aa, Heterodera glycines
  Coding regions on vcDNA: vcDNA=SeqID_96931; Strand=+; Position=3-416
PTKMSNLFVASSAVVFLLLQLHFVVTFASSFEGAPPKANEEAMPTTGEQDGGAEFGGSKQKMARKMMRYNGNNFDKVSVLFIRREMALRKLQLQINVLEQQLANALSSAFAAGCPPSGVSSVSDGISHRRHLPMPRE

SEQ ID NO: 170509 - protein, 137 aa, Heterodera glycines
  Homolog annotation: Hit_ID=NP_505030.1; Match level="QueryCoverage =97%, HitCoverage=61%, E-value=2e-48, Identity=65%"; Hit description =Phosphatidylethanolamine-Binding protein bovin like (24.1 kD) (5I359) [Caenorhabditis elegans] gb|AAB6532
  Gene Ontology: Mol. function=phosphatidylethanolamine binding; Cellular component=cytoplasm
  Coding regions on vcDNA: vcDNA=SeqID_96932; Strand=+; Position=98-548
MSTSEEFKKQTIVPDVVTKAPEKRAKVVLDSGVEANLGNVLTPTQVQNPPKVTWEAEAGKLYSLIMTDPDAPSRKEPKFREWHHWLVVNIPGTEVDKGDVLSEYVGSGPPQDTGLHRYVYLIYQQKNTIKDTEHGHL

SEQ ID NO: 170510 - protein, 124 aa, Heterodera glycines
  Coding regions on vcDNA: vcDNA=SeqID_96933; Strand=+; Position=3-374
ISFILFVKAFGGGSPKKNKKINDGLAQRMSKLLSTGAYADVQFVVEEGDKKELLLAHKAILSHASEEFALILGFDTQNSSHSNGKISAETIKTVLVTDVTIGAFKVMLSFIYTEGLKGDKLSVC

SEQ ID NO: 170511 - protein, 134 aa, Heterodera glycines; identical to SEQ ID NO: 164357
  Coding regions on vcDNA: vcDNA=SeqID_96934; Strand=+; Position=9-413

SEQ ID NO: 170512 - protein, 68 aa, Heterodera glycines; identical to SEQ ID NO: 164352
  Homolog annotation: Hit_ID=NP_572998.1; Match level="QueryCoverage =100%, HitCoverage=76%, E-value=6e-13, Identity=52%"; Hit description= CG9065-PA [Drosophila melanogaster] gb|AAF48421.1| CG9065-PA [Drosophila melanogaster]
  Coding regions on vcDNA: vcDNA=SeqID_96935; Strand=+; Position=2-208

SEQ ID NO: 170513 - protein, 71 aa, Heterodera glycines
  Coding regions on vcDNA: vcDNA=SeqID_96936; Strand=-; Position=147-362
FLSNPTLIKSRKLIKNDEKTTNLGKNCYNKIPILPITRAICCLSLISHWWHIASAYANAQNAWPSEQLGGH

SEQ ID NO: 170514 - protein, 46 aa, Heterodera glycines
  Coding regions on vcDNA: vcDNA=SeqID_96937; Strand=+; Position=5-145
TLPLLQFLLAVSFCFPSDPSDEFAVPFLPSMTHPQKAINSLIFLLP

SEQ ID NO: 170515 - protein, 219 aa, Heterodera glycines; identical to SEQ ID NO: 162410
  misc_feature (191)..(191): Xaa can be any naturally occurring amino acid
  Coding regions on vcDNA: vcDNA=SeqID_96938; Strand=+; Position=16-672

SEQ ID NO: 170516 - protein, 98 aa, Heterodera glycines
  Coding regions on vcDNA: vcDNA=SeqID_96939; Strand=+; Position=21-317
MTDQQNSIDGGWTEQNVNDEKIKSLASRSVAKINSESNDRFSLFPLEVGRSNCSKNQSNLADHANCATEDGQTARKTFLVTIWEKPWEQFEQITYKLE

SEQ ID NO: 170517 - protein, 117 aa, Heterodera glycines
  Coding regions on vcDNA: vcDNA=SeqID_96940; Strand=+; Position=13-366
MLSPFTYDPFNRRSLWPMTTIVGNVLSPFRQLERELDHFFDGMQPMLRDHVAQLNVSNKGDFTYKVDVSGFRPEEINVEVVGNEFIVNGEHREQNDSGFCYVARALKFAETNIGAWC

SEQ ID NO: 170518 - protein, 110 aa, Heterodera glycines; identical to SEQ ID NO: 164351
  Coding regions on vcDNA: vcDNA=SeqID_96941; Strand=-; Position=2-331

SEQ ID NO: 170519 - protein, 38 aa, Heterodera glycines
  Coding regions on vcDNA: vcDNA=SeqID_96942; Strand=+; Position=3-119
IQIVQNGSCELIRNKRKTKNHACRPISRIKMTFSFRVK

SEQ ID NO: 170520 - protein, 130 aa, Heterodera glycines; identical to SEQ ID NO: 163806
  Homolog annotation: Hit_ID=NP_502336.1; Match level="QueryCoverage =87%, HitCoverage=93%, E-value=7e-12, Identity=33%"; Hit description =putative membrane protein (13.8 kD) (4N46) [Caenorhabditis elegans] gb|AAB97553.1| Hypothetical protein C
  Coding regions on vcDNA: vcDNA=SeqID_96943; Strand=+; Position=5-397

SEQ ID NO: 170521 - protein, 98 aa, Heterodera glycines
  Coding regions on vcDNA: vcDNA=SeqID_96944; Strand=+; Position=3-299
FKMTLNPPHLTLRGYEGHDYMGDTFKKTNDYAQTWFVPLMRGQSIDIRQIPGDDCGFFEDQSECVSRTKKNKRFWKIRDVRFKKWLRGETPHIFRTIG

SEQ ID NO: 170522 - protein, 76 aa, Heterodera glycines
  Coding regions on vcDNA: vcDNA=SeqID_96945; Strand=+; Position=56-286
MFLMEVNGEVHVQSSLAPSHQVVKRHCSCGGSWGGWGGGGGACCSCGQCGNMGGYSSGGCYGCMSGMGGCYCGKKK

SEQ ID NO: 170523 - protein, 124 aa, Heterodera glycines; identical to SEQ ID NO: 168234
  Coding regions on vcDNA: vcDNA=SeqID_96946; Strand=-; Position=1-372

SEQ ID NO: 170524 - protein, 133 aa, Heterodera glycines
  Coding regions on vcDNA: vcDNA=SeqID_96947; Strand=+; Position=27-428
NKSLSSTAVSSKEFWAQLLHRKTMVDHEKNKEVIHAISYLGKDPYFGYSVQHFGHSFYYSEEKTPQYAQQSFGRRVGRLYAKAQSHDPCKTQIRPKFAPPILQQRQSVGTGRANAEDIHGQLNRTDENWRNEI

SEQ ID NO: 170525 - protein, 127 aa, Heterodera glycines; identical to SEQ ID NO: 168233
  Homolog annotation: Hit_ID=NP_500377.1; Match level="QueryCoverage =86%, HitCoverage=68%, E-value=3e-21, Identity=47%"; Hit description =putative protein, with a coiled coil domain, of bilaterial origin (17.4 kD) (4E346) [Caenorhabditis elega
  Coding regions on vcDNA: vcDNA=SeqID_96948; Strand=+; Position=16-399

SEQ ID NO: 170526 - protein, 144 aa, Heterodera glycines
  Homolog annotation: Hit_ID=CAE72234.1; Match level="QueryCoverage =71%, HitCoverage=34%, E-value=2e-28, Identity=53%"; Hit description =Hypothetical protein CBG19349 [Caenorhabditis briggsae]
  Coding regions on vcDNA: vcDNA=SeqID_96949; Strand=+; Position=3-437
YGQQQGQAYHPRGANPYQLQPGWNVPPPPQGQQPYNAQHFATITKRDLTSMLGIVFIATMCLALFGLVVIIVGMFTNVRILFVVYAAIGAFLFMIWLAIDIQMVMGGRTYEISPEEHIFASITLFLDIIQIFWFLLAIFGDRRN

SEQ ID NO: 170527 - protein, 143 aa, Heterodera glycines
  Homolog annotation: Hit_ID=NP_499298.1; Match level="QueryCoverage =70%, HitCoverage=14%, E-value=4e-13, Identity=36%"; Hit description =FtsH protease (3L509) [Caenorhabditis elegans] emb|CAA88955.1| Hypothetical protein M03C11.5 [Caenorhabdi
  Gene Ontology: Mol. function=ATP-dependent peptidase activity; Cellular component=mitochondrial inner membrane; Biological process =mitochondrion organization and biogenesis
  Coding regions on vcDNA: vcDNA=SeqID_96950; Strand=+; Position=2-433
QWRRAGLIKALLCGEELTWTIPDERERELMAWHEVGHGAFAAKDKDAIPLRYLSILPMYDSIGQTYCMPKSDAQTMSVAQVRAEISGFLAGTIAERMSYGSNKVTTSCSSDLKSAYQAEQQAQQNQDDQNHGGQEATDEEYCR

SEQ ID NO: 170528 - protein, 78 aa, Heterodera glycines
  Coding regions on vcDNA: vcDNA=SeqID_96951; Strand=-; Position=1-234
FFAPLKFYLSFHKFHLKFSPFSVFLWHPFIFGPLFLNWPRRLRLRRLPQHLLFPLKWRTVHNWHKGDFDEKQKAQNGA

SEQ ID NO: 170529 - protein, 51 aa, Heterodera glycines
  Homolog annotation: Hit_ID=CAE72941.1; Match level="QueryCoverage =82%, HitCoverage=13%, E-value=3e-09, Identity=69%"; Hit description =Hypothetical protein CBG20269 [Caenorhabditis briggsae]
  Coding regions on vcDNA: vcDNA=SeqID_96952; Strand=+; Position=23-175
LEKQRNSDEMNYLRQVGEILSRGTVRTDRTGTGTISIFGMQTRYSLRGSQS

SEQ ID NO: 170530 - protein, 68 aa, Heterodera glycines
  Homolog annotation: Hit_ID=AAK26378.1; Match level="QueryCoverage =58%, HitCoverage=12%, E-value=7e-17, Identity=95%"; Hit description =putative zinc finger protein [Heterodera glycines]
  Coding regions on vcDNA: vcDNA=SeqID_96953; Strand=+; Position=2-205
RDFSHDDHINNAIGTNGDSKDASKRKDICRDFLNNICSRGGGKGIIREATQFFVCLINHLHKFNFLKK

SEQ ID NO: 170531 - protein, 45 aa, Heterodera glycines
  Coding regions on vcDNA: vcDNA=SeqID_96954; Strand=+; Position=39-173
LDSAEPYLQRFGGLDGESVLTWDRRKYLIVYRDIICCFIIVKISV

SEQ ID NO: 170532 - protein, 104 aa, Heterodera glycines
  Coding regions on vcDNA: vcDNA=SeqID_96955; Strand=-; Position=68-382
KSHHIFFVMTLRQSMIKCNKNTYCERVGNEQNTKHALHKTTDGTEAKGARAARVRSAPVQHGVDLAHDVHLAPVVPPGQVLLQLNERDAKITTDFGIQIKNAIN

SEQ ID NO: 170533 - protein, 48 aa, Heterodera glycines; identical to SEQ ID NO: 168215
  Coding regions on vcDNA: vcDNA=SeqID_96956; Strand=+; Position=28-174

SEQ ID NO: 170534 - protein, 48 aa, Heterodera glycines; identical to SEQ ID NO: 164339
  Coding regions on vcDNA: vcDNA=SeqID_96957; Strand=+; Position=2-145

SEQ ID NO: 170535 - protein, 58 aa, Heterodera glycines
  Coding regions on vcDNA: vcDNA=SeqID_96958; Strand=-; Position=2-175
LKYSLCVQSTFVGAVRVGFFPNNPSHLWSGLVFRQNIIHLLAQMKGVFVRHFPEKCFN

SEQ ID NO: 170536 - protein, 50 aa, Heterodera glycines
  Coding regions on vcDNA: vcDNA=SeqID_96959; Strand=-; Position=2-151
LKSNGIFIFKNNLLFQLLIALLGSHCPSAQLSKAFDCATSKVDHSECCRQ

SEQ ID NO: 170537 - protein, 44 aa, Heterodera glycines
  Coding regions on vcDNA: vcDNA=SeqID_96960; Strand=+; Position=3-137
FAFEQPISSFHWFVRFRDYVKVTGSDSGEIALWDIRSGKNELNS

SEQ ID NO: 170538 - protein, 49 aa, Heterodera glycines; identical to SEQ ID NO: 137744
  Coding regions on vcDNA: vcDNA=SeqID_96961; Strand=+; Position=3-149

SEQ ID NO: 170539 - protein, 58 aa, Heterodera glycines
  Coding regions on vcDNA: vcDNA=SeqID_96962; Strand=+; Position=3-179
HLETIDALDIYPTGATEEQKCRCREKRKCMVDTVQTLLNENDKYTFRLDQYRKSLLYK

SEQ ID NO: 170540 - protein, 61 aa, Heterodera glycines
  Coding regions on vcDNA: vcDNA=SeqID_96963; Strand=+; Position=2-184
NLSPEVLCLGRGRRSLCSFFGHRSSFEEQLIKLQSQIVLIMTIFVSHINDEIRMLLKRSLF

SEQ ID NO: 170541 - protein, 54 aa, Heterodera glycines; identical to SEQ ID NO: 168200
  Coding regions on vcDNA: vcDNA=SeqID_96964; Strand=+; Position=1-165

SEQ ID NO: 170542 - protein, 61 aa, Heterodera glycines
  Coding regions on vcDNA: vcDNA=SeqID_96965; Strand=-; Position=1-186
ISFYLVTPILRPMKRAIGRPLVRTNRKEFSETAKCGQKEVLFEQVKILDRANSLWTDITKK

SEQ ID NO: 170543 - protein, 52 aa, Heterodera glycines
  Coding regions on vcDNA: vcDNA=SeqID_96966; Strand=-; Position=0-155
ERTSLEFFFFFFLTVSSAFAVFIGICLHQLRVTAPFGTSVGVVRQWLRRNNS

SEQ ID NO: 170544 - protein, 71 aa, Heterodera glycines
  Coding regions on vcDNA: vcDNA=SeqID_96967; Strand=-; Position=1-213
FGYVLGHHTVTVESDSIYQPHVTECHFLILTTPALLQQIKNPPPNRIRATNGQSLAFMRMYRNSVILFENV

SEQ ID NO: 170545 - protein, 71 aa, Heterodera glycines; identical to SEQ ID NO: 164335
  misc_feature (5)..(6): Xaa can be any naturally occurring amino acid
  Coding regions on vcDNA: vcDNA=SeqID_96968; Strand=+; Position=37-252

SEQ ID NO: 170546 - protein, 64 aa, Heterodera glycines
  Coding regions on vcDNA: vcDNA=SeqID_96969; Strand=-; Position=0-191
HLFRILSQKIMEKFVSIPMLSSVLNPAISANFRVRLAFLTHSLCFVRQFVHFYGRSFDQKMNSS

SEQ ID NO: 170547 - protein, 47 aa, Heterodera glycines; identical to SEQ ID NO: 167945
  Coding regions on vcDNA: vcDNA=SeqID_96970; Strand=-; Position=1-141

SEQ ID NO: 170548 - protein, 23 aa, Heterodera glycines
  Coding regions on vcDNA: vcDNA=SeqID_96971; Strand=-; Position=53-124
ERELVSRFFFFFFFFFFFFFFFF

SEQ ID NO: 170549 - protein, 39 aa, Heterodera glycines
  Coding regions on vcDNA: vcDNA=SeqID_96972; Strand=-; Position=3-119
SRMGLTHPILVLSLAKRRMNVEQCGKTHGVMQRGEKVGH

SEQ ID NO: 170550 - protein, 64 aa, Heterodera glycines
  Coding regions on vcDNA: vcDNA=SeqID_96973; Strand=+; Position=1-192
EKERDILVSLASKHRTVPYDVLMNALKIANEREFEDFIIESIYQDIIQVNDGFEIMMENLGSNH

SEQ ID NO: 170551 - protein, 129 aa, Heterodera glycines
  Homolog annotation: Hit_ID=CAE70001.1; Match level="QueryCoverage =92%, HitCoverage=19%, E-value=5e-34, Identity=52%"; Hit description =Hypothetical protein CBG16408 [Caenorhabditis briggsae]
  Gene Ontology: Mol. function=carnitine O-palmitoyltransferase activity; Cellular component=mitochondrial inner membrane; Biological process=acyl-CoA metabolism
  Coding regions on vcDNA: vcDNA=SeqID_96974; Strand=+; Position=3-392
GHKRYTGEVMNGMGMDRHLLGIRLLAAEHGVPLPELLGSDIYQRLLHFRLSTSQLPTSHVLPMGFGPSAPDCYGVCYNPQENHIFFIITAFNDCAETSAERFANALERALLDMRDLVDWAGRLKGRAKL

SEQ ID NO: 170552 - protein, 121 aa, Heterodera glycines
  Coding regions on vcDNA: vcDNA=SeqID_96975; Strand=+; Position=11-376
KPVNKMRTQSIFSIFFLLLIFEVINSFPSKSSESGEPPANGAEVAQSRKKRQAEEVTTEEPPSETNDAEGAEDHQSAAAGNGKAPKNKGKKNKSDSSDSSSSSSSSSESDEKKKLKKKNKH

SEQ ID NO: 170553 - protein, 112 aa, Heterodera glycines
  Coding regions on vcDNA: vcDNA=SeqID_96976; Strand=+; Position=2-340
VEYAMLENEIGVKMDELQGLIMALSYSHQIVNMAVSMPEPVYQADELAKRGKNNFAALKRFKPNQVPKKEHRLLAKKGAKRQTISLVDHHELNRILSYWGDGTFVLSNRFTA

SEQ ID NO: 170554 - protein, 133 aa, Heterodera glycines
  Coding regions on vcDNA: vcDNA=SeqID_96977; Strand=-; Position=2-400
ILSFHSLLQNDFSHNVINHYQIFKVSSSFRSSASSSLLLRLLQRISAGATFPPLRFFRSAAAPSADGGGGGTPSPAADGSAAARAAEGFSSAASEDGDESSAEHWTTKSAKRARDRTKRILNREMPIHNRIFL

SEQ ID NO: 170555 - protein, 71 aa, Heterodera glycines; identical to SEQ ID NO: 168177
  misc_feature (45)..(45): Xaa can be any naturally occurring amino acid
  Coding regions on vcDNA: vcDNA=SeqID_96978; Strand=+; Position=2-217

SEQ ID NO: 170556 - protein, 159 aa, Heterodera glycines
  misc_feature (138)..(138): Xaa can be any naturally occurring amino acid
  misc_feature (149)..(149): Xaa can be any naturally occurring amino acid
  Homolog annotation: Hit_ID=AAL78229.1; Match level="QueryCoverage =100%, HitCoverage=86%, E-value=4e-86, Identity=97%"; Hit description= SCN esophageal gland cell protein [Heterodera glycines]
  Coding regions on vcDNA: vcDNA=SeqID_96979; Strand=+; Position=25-503
MNPNGFFFVLAVLFLVKVDFLQCKYNEPMARQVLQKHASQFQQHCKNARRGSAVAKCCSAIRSIMGRFTSQKKAMNQMLAKCKAGTTPSEAQQMRRKLEGSNKLKDCGQFKSQIQHKFSELKQYCNNGAENEEENDEXSEREREEERVXKREEQQNSNH

SEQ ID NO: 170557 - protein, 159 aa, Heterodera glycines; identical to SEQ ID NO: 164321
  misc_feature (138)..(138): Xaa can be any naturally occurring amino acid
  misc_feature (149)..(149): Xaa can be any naturally occurring amino acid
  Homolog annotation: Hit_ID=AAL78229.1; Match level="QueryCoverage =100%, HitCoverage=86%, E-value=8e-84, Identity=96%"; Hit description= SCN esophageal gland cell protein [Heterodera glycines]
  Coding regions on vcDNA: vcDNA=SeqID_96980; Strand=+; Position=21-499

SEQ ID NO: 170558 - protein, 37 aa, Heterodera glycines
  Coding regions on vcDNA: vcDNA=SeqID_96981; Strand=+; Position=154-267
LICYLRPITLKVPLKLIIKRQFKKIKKKITNYSKKKL

SEQ ID NO: 170559 - protein, 91 aa, Heterodera glycines
  misc_feature (10)..(10): Xaa can be any naturally occurring amino acid
  Homolog annotation: Hit_ID=AAL78220.1; Match level="QueryCoverage =53%, HitCoverage=32%, E-value=2e-21, Identity=93%"; Hit description =putative cysteine proteinase [Heterodera glycines]
  Coding regions on vcDNA: vcDNA=SeqID_96982; Strand=+; Position=1-275
ERIGKALDEXMPRNGQNESFGGDRITQTECHNKVMHTFNKICFNFSKSPYVMKYAKTLANLCERRADTAQIVAILNEQCAQMEKMEVHYSN

SEQ ID NO: 170560 - protein, 74 aa, Heterodera glycines
  Coding regions on vcDNA: vcDNA=SeqID_96983; Strand=+; Position=15-239
MMPSSPSSAPLGANVLVTGANRGIGLGIVKEILKTDGIVHLLAGCRNPSQAEVLWEFVDSFCFVELKFKRFYFN

SEQ ID NO: 170561 - protein, 171 aa, Heterodera glycines
  Coding regions on vcDNA: vcDNA=SeqID_96984; Strand=-; Position=1-513
LILPFIKHSPLNVFLHRMNGLFEVAISDYYLFVFARLILTFIRLAFSAHLRPTGIRSFIISTFISFIAGVLFRNRCGPFAPSVNGVDLVRFFGVGENQFCAPNNSRGNECPFLPGKVRHFGKCRRLLCRTRETSGWPLSAKLGKKLGRKTEKSPTEMKMNSLRWKGFEFQW

SEQ ID NO: 170562 - protein, 94 aa, Heterodera glycines
  Homolog annotation: Hit_ID=XP_315595.1; Match level="QueryCoverage =94%, HitCoverage=11%, E-value=4e-14, Identity=35%"; Hit description =ENSANGP00000017704 [Anopheles gambiae]
  Gene Ontology: Cellular component=integral to membrane
  Coding regions on vcDNA: vcDNA=SeqID_96985; Strand=+; Position=134-418
MAMEFRRDIVMGAIVRLILRAFCDFVRVQKFSRHGFEQLQVDFAYVRQKLWYFVADEHMLNTCIEDIVTAAVNQCAQPKLLDPSVVRRICEEMQ

SEQ ID NO: 170563 - protein, 175 aa, Heterodera glycines
  Homolog annotation: Hit_ID=NP_492045.1; Match level="QueryCoverage =82%, HitCoverage=15%, E-value=2e-15, Identity=34%"; Hit description =PAZ Piwi domain protein family member (105.4 kD) (1H813) [Caenorhabditis elegans] emb|CAA95839.1| Hypothe
  Gene Ontology: Mol. function=translation initiation factor activity; Cellular component=eukaryotic 48S initiation complex; Biological process=gametogenesis
  Coding regions on vcDNA: vcDNA=SeqID_96986; Strand=+; Position=291-818
NIHDEFPSYVKACKKYDPTWEPKFVYCIVDKNHNKRFFVKGQQQVENTAPGAVIDSKVVRVDIHEFWMQSHVPLKGTSKMPQYIFPVNDPKANNNELQGFLLALCCSWQIVTLAPALPTPVRQAKELAKRGRANFGELKRTPQYIPRAENQQIDYQQLNRRLCYNGHIFADTRNA

SEQ ID NO: 170564 - protein, 93 aa, Heterodera glycines
  misc_feature (41)..(41): Xaa can be any naturally occurring amino acid
  Homolog annotation: Hit_ID=CAB55573.1; Match level="QueryCoverage =100%, HitCoverage=23%, E-value=5e-29, Identity=64%"; Hit description= NADH-ubiquinone oxidoreductase subunit 4 [Globodera pallida]
  Gene Ontology: Mol. function=NADH dehydrogenase (ubiquinone) activity; Biological process=mitochondrial electron transport, NADH to ubiquinone
  Coding regions on vcDNA: vcDNA=SeqID_96987; Strand=-; Position=3-280
LPKIHVEASTVASILLAGILLKFGVHGFSRFLISFLFSNSXFFLFIAIIGLFFCSLICLIQRDLKSLVAFSSVFHISIILIIYLVFFQLGKNG

SEQ ID NO: 170565 - protein, 53 aa, Heterodera glycines
  Coding regions on vcDNA: vcDNA=SeqID_96988; Strand=-; Position=1-159
AKLYQSLSLIIIINSLSFLPFVLFLHSFIFSCFSSHFALCLFPNISSSSQFSP

SEQ ID NO: 170566 - protein, 82 aa, Heterodera glycines
  Coding regions on vcDNA: vcDNA=SeqID_96989; Strand=+; Position=68-316
MSSLQPLFFAALFLAVFCLCAIAMPAQPEGPMFEGGQHQAEAGRAKRWSPYYYGAYGGWGGAYPYASSYYGHAYPYYSGYWW

SEQ ID NO: 170567 - protein, 66 aa, Heterodera glycines
  Coding regions on vcDNA: vcDNA=SeqID_96990; Strand=+; Position=54-254
MPFLRSLLLPSVLLLLLLLLLSVSLCSAGVFAPLRMKRQFDWFGNSMGAAWRRLRRRMGVRQKMNR

SEQ ID NO: 170568 - protein, 59 aa, Heterodera glycines
  Coding regions on vcDNA: vcDNA=SeqID_96991; Strand=-; Position=1-177
LAAFFNHKVLSTKNHILTFFRLLPKNPPPFGEIADCHSLRCSVPLSFVVLIDDNFLLLL

SEQ ID NO: 170569 - protein, 134 aa, Heterodera glycines; identical to SEQ ID NO: 168168
  Coding regions on vcDNA: vcDNA=SeqID_96992; Strand=-; Position=3-404

SEQ ID NO: 170570 - protein, 137 aa, Heterodera glycines
  misc_feature (108)..(108): Xaa can be any naturally occurring amino acid
  Homolog annotation: Hit_ID=AAL78212.1; Match level="QueryCoverage =97%, HitCoverage=100%, E-value=3e-28, Identity=48%"; Hit description= putative esophageal gland cell secretory protein Hgg-25 [Heterodera glycines]
  Coding regions on vcDNA: vcDNA=SeqID_96993; Strand=+; Position=67-526
MRTFLFIAVVGLMLAVILENVNATGKNSPSKGKPSPDSTNHKKDHKNEHPKYEAELIYEQGKPSPDSPKYDSPILAGSSGSPKKGKSPNADPKKAASHLVPVTPGKVXEQSLKMVKKLCGTMMPTMNKPKAVVVDVE

SEQ ID NO: 170571 - protein, 138 aa, Heterodera glycines
  misc_feature (53)..(53): Xaa can be any naturally occurring amino acid
  Homolog annotation: Hit_ID=CAE60401.1; Match level="QueryCoverage =92%, HitCoverage=34%, E-value=1e-25, Identity=44%"; Hit description =Hypothetical protein CBG04003 [Caenorhabditis briggsae]
  Gene Ontology: Biological process=positive regulation of growth rate
  Coding regions on vcDNA: vcDNA=SeqID_96994; Strand=+; Position=2-416
ERSMKALIGTVDELNKAVNAYGKYTVEKQKYDTMYNNLMQKRQTENEARQSRXGEPPLTMEDIKRQLKQPQMQTKYGMLDLLLNALDTDAFTTYQIQTTNENVAKLHLSQAVSAQPVVAASSAAIGTSAANAPNLERK

SEQ ID NO: 170572 - protein, 33 aa, Heterodera glycines; identical to SEQ ID NO: 164326
  Coding regions on vcDNA: vcDNA=SeqID_96995; Strand=+; Position=2-103

SEQ ID NO: 170573 - protein, 46 aa, Heterodera glycines
  Coding regions on vcDNA: vcDNA=SeqID_96996; Strand=-; Position=46-186
HFIVNFCTTLRPSLSKSPPKRRHSNPIAQIGMFNRTELRNVRKCSD

SEQ ID NO: 170574 - protein, 155 aa, Heterodera glycines
  Coding regions on vcDNA: vcDNA=SeqID_96997; Strand=+; Position=38-502
MNCSFFLCLFTVQLILLNFAVEGREDDELKRKKRNTDVDVLGLVNIHAPSRKNVNVDVGGEERDRNDKLVNVNVQGHRKNVNVDVGGGHYNEGKVVKYERDGERGREVNVDVRVPKVKVDVDREDGYPKKKRVHLKVLDKLRKYDSEESGERKRH

SEQ ID NO: 170575 - protein, 177 aa, Heterodera glycines
  Homolog annotation: Hit_ID=AAC48326.1; Match level="QueryCoverage =100%, HitCoverage=55%, E-value=4e-97, Identity=96%"; Hit description= beta-1,4-endoglucanase-2 precursor [Heterodera glycines]
  Coding regions on vcDNA: vcDNA=SeqID_96998; Strand=+; Position=97-630
MFVQLVLLAIVGITFVDAAAPPFGQLSVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKIISTIHTIHKNN

SEQ ID NO: 170576 - protein, 118 aa, Heterodera glycines
  misc_feature (90)..(91): Xaa can be any naturally occurring amino acid
  Homolog annotation: Hit_ID=AAL78212.1; Match level="QueryCoverage =97%, HitCoverage=100%, E-value=2e-37, Identity=61%"; Hit description= putative esophageal gland cell secretory protein Hgg-25 [Heterodera glycines]
  Coding regions on vcDNA: vcDNA=SeqID_96999; Strand=+; Position=88-488
MRTFLFIAVVGLMLAVILENVNATGKNSPTKGKQSLDSPNHEKDHKNEHEKYEAAYFQKNRRQTVQRKSPHADPKKAASHLVPVTPGKVXXASLKMVKKLCGTMMPTMNKPKAVVVDV

SEQ ID NO: 170577 - protein, 115 aa, Heterodera glycines
  misc_feature (34)..(34): Xaa can be any naturally occurring amino acid
  Homolog annotation: Hit_ID=AAP30772.1; Match level="QueryCoverage =65%, HitCoverage=98%, E-value=2e-19, Identity=54%"; Hit description =putative gland protein G23G12 [Heterodera glycines]
  Coding regions on vcDNA: vcDNA=SeqID_97000; Strand=+; Position=90-438
MRTFLFIAVVGLMLAVILENVNATGKNSPSKGKXSPDSTNHKKDHKNEHPKYEAELIYEQGKPSPDSPKYDSPILAGSSGSPKKRKIAECRSEKSCFTPCASNTRESMMSKVLKW

SEQ ID NO: 170578 - protein, 100 aa, Heterodera glycines
  Coding regions on vcDNA: vcDNA=SeqID_97001; Strand=+; Position=173-475
LTVRHNYNNKLIYFPCYSVLLRCSFPAFESLLFSGSFFPNFQRYPFPSRIKLFAFNLLYLFCSFVRCFSEALKAYNFPSSSAITYVLRIPMKILLKIIFI

SEQ ID NO: 170579 - protein, 195 aa, Heterodera glycines
  misc_feature (66)..(66): Xaa can be any naturally occurring amino acid
  misc_feature (133)..(133): Xaa can be any naturally occurring amino acid
  Homolog annotation: Hit_ID=NP_955136.1; Match level="QueryCoverage =76%, HitCoverage=88%, E-value=3e-30, Identity=42%"; Hit description =CNPV113 thymidine kinase [Canarypox virus] gb|AAR83459.1| CNPV113 thymidine kinase [Canarypox virus]
  Coding regions on vcDNA: vcDNA=SeqID_97002; Strand=+; Position=1-619
IPRTELFRLAQRYILAGRKVAVVKYALDTRYDESHACTHDKRKMEAISATKMEDAFEEIWHFHLCXFKDIVKYAQELANTGKTVIIAALNGDYRQEPFQNVAMLIPLAEKIEKLSAVCRCGQSASFTFRMSEXHELEMIGGQELYRALCRTCVVEYNHVKQQLLNGLKKNGNVSLAKKRKASDATAHPTLRIDTV

SEQ ID NO: 170580 - protein, 97 aa, Heterodera glycines; identical to SEQ ID NO: 138551
  Homolog annotation: Hit_ID=AAC48326.1; Match level="QueryCoverage =98%, HitCoverage=30%, E-value=8e-13, Identity=38%"; Hit description =beta-1,4-endoglucanase-2 precursor [Heterodera glycines]
  Coding regions on vcDNA: vcDNA=SeqID_97003; Strand=+; Position=7-300

SEQ ID NO: 170581 - protein, 86 aa, Heterodera glycines
  Coding regions on vcDNA: vcDNA=SeqID_97004; Strand=+; Position=2-262
QIAEIIAKKPKYCGERFAKMRDKVCRWPGEQQPCLQLHHSIKERVRTKCCAEGCSLEEMKEEMCCMTDACLRRCYPGKGYRLGSVY

SEQ ID NO: 170582 - protein, 31 aa, Heterodera glycines; identical to SEQ ID NO: 168161
  Coding regions on vcDNA: vcDNA=SeqID_97005; Strand=+; Position=2-97

SEQ ID NO: 170583 - protein, 131 aa, Heterodera glycines; identical to SEQ ID NO: 164066
  Coding regions on vcDNA: vcDNA=SeqID_97006; Strand=-; Position=255-650

SEQ ID NO: 170584 - protein, 124 aa, Heterodera glycines
  Coding regions on vcDNA: vcDNA=SeqID_97007; Strand=-; Position=82-456
EMRQFLSFLKRKLTTQYGRSLIVVPFWLVHLLADQSVFTNYCFCYAPPSSVVFQNCGQNMPPPPPPLPPIPWPCCILLMLPPPPPIPGSHAVASHLAPSPAHLSASPIASKHSMNLNWCHEEKH

SEQ ID NO: 170585 - protein, 76 aa, Heterodera glycines; identical to SEQ ID NO: 164102
  Coding regions on vcDNA: vcDNA=SeqID_97008; Strand=+; Position=1-231

SEQ ID NO: 170586 - protein, 138 aa, Heterodera glycines
  Coding regions on vcDNA: vcDNA=SeqID_97009; Strand=+; Position=28-444
MSHNQRGNANANMGPPQGVGSGSSAENSDSSADNQPSNEQWEAAFNSIGDFSHFVRQVFHSVVHGMAVNDSSIFPPNSAQARNGFTANSRVTGFTPSIVNPPLSHESDELFMNIGAVQGLIAMPIPPRENAPQNQHHP

SEQ ID NO: 170587 - protein, 88 aa, Heterodera glycines; identical to SEQ ID NO: 168159
  Coding regions on vcDNA: vcDNA=SeqID_97010; Strand=+; Position=1-267

SEQ ID NO: 170588 - protein, 367 aa, Heterodera glycines
  misc_feature (248)..(248): Xaa can be any naturally occurring amino acid
  misc_feature (275)..(275): Xaa can be any naturally occurring amino acid
  Homolog annotation: Hit_ID=AAH84827.1; Match level="QueryCoverage =88%, HitCoverage=59%, E-value=1e-40, Identity=32%"; Hit description =Unknown (protein for MGC:85322) [Xenopus laevis]
  Gene Ontology: Mol. function=cytochrome P450 activity; Cellular component=membrane; Biological process=electron transport
  Coding regions on vcDNA: vcDNA=SeqID_97011; Strand=+; Position=1-1104
FGRFLLDVIGRCGFSLDLDTFDEENIFVKQARTIFDFTRKGQKLRMILGVFFPCVSLLYENITGKSFAFAMDEEFFMEMMSDLYEKRRADPEAKEKYADIFQLLMNAVDDEEFTISADDAEIIHSELRSNEQQQKQQGKASDQETELFAQSFIILIAGFETTGATLSFAAYMLAIESEIQEKLREEVIDVLGENEMITYEHLKRMNYLRAFVQETLRMFPVAPKMNRVCNSDCVINGVPFERGDLITXPIYVIQHDETFFPDPFKFDPTRLLPEXKAEIDSLAFLTFGLGPRNCIGMPCAEFQMQVALALIVRRLRFSPGPNTPDSEISAQIALFGNASHRTTTCCASRKNLNLKKQSPSTIIFFNI

SEQ ID NO: 170589 - protein, 110 aa, Heterodera glycines; identical to SEQ ID NO: 164128
  Homolog annotation: Hit_ID=NP_495956.1; Match level="QueryCoverage =90%, HitCoverage=21%, E-value=1e-19, Identity=44%"; Hit description =integral membrane protein (2J458) [Caenorhabditis elegans] pir||T25203 probable membrane-bound phosphoest
  Coding regions on vcDNA: vcDNA=SeqID_97012; Strand=+; Position=12-344

SEQ ID NO: 170590 - protein, 73 aa, Heterodera glycines; identical to SEQ ID NO: 164050
  Coding regions on vcDNA: vcDNA=SeqID_97013; Strand=+; Position=14-235

SEQ ID NO: 170591 - protein, 90 aa, Heterodera glycines; identical to SEQ ID NO: 168156
  Coding regions on vcDNA: vcDNA=SeqID_97014; Strand=-; Position=54-326

SEQ ID NO: 170592 - protein, 102 aa, Heterodera glycines
  Homolog annotation: Hit_ID=AAK61382.1; Match level="QueryCoverage =76%, HitCoverage=83%, E-value=2e-14, Identity=46%"; Hit description =basic proline-rich protein [Sus scrofa]
  Coding regions on vcDNA: vcDNA=SeqID_97015; Strand=+; Position=8-446
MIRLPFLSLALAFSAVLLVLCDDLPCPTDPSSAPLPPGCPPPPADADCAPPNGTPPPGAPPPGTPPPGTSPPCRRQRGGPAGGGVGAAQHPPNGPPPTTPKP

SEQ ID NO: 170593 - protein, 81 aa, Heterodera glycines
  Coding regions on vcDNA: vcDNA=SeqID_97016; Strand=+; Position=205-447
IHETVDPICLFCSFFDTFARYLLVSYLFITLQFVFFIFLRYFLIDLHRYRYVINEFIHLSIISALYVFPTYLSLITRKRIE

SEQ ID NO: 170594 - protein, 91 aa, Heterodera glycines; identical to SEQ ID NO: 162303
  Coding regions on vcDNA: vcDNA=SeqID_97017; Strand=+; Position=215-490

SEQ ID NO: 170595 - protein, 56 aa, Heterodera glycines
  Coding regions on vcDNA: vcDNA=SeqID_97018; Strand=+; Position=3-170
HLQRTSRRKLADEIAAVIKRDRSRSASRASLERISREVRHKFAHYTPQKKKQQLPR

SEQ ID NO: 170596 - protein, 40 aa, Heterodera glycines; identical to SEQ ID NO: 168151
  Coding regions on vcDNA: vcDNA=SeqID_97019; Strand=+; Position=3-125

SEQ ID NO: 170597 - protein, 99 aa, Heterodera glycines
  Coding regions on vcDNA: vcDNA=SeqID_97020; Strand=+; Position=3-302
PFLPPLIHSLLSSFSSKMATSAKIFVLLFVLLTVALLVEQATAQWGLLLPVLRQTRGRVRPPGQCQRKRRRARGRRRARDVQILKKGGRKKRSKSDRID

SEQ ID NO: 170598 - protein, 65 aa, Heterodera glycines; identical to SEQ ID NO: 168150
  Coding regions on vcDNA: vcDNA=SeqID_97021; Strand=-; Position=2-196

SEQ ID NO: 170599 - protein, 94 aa, Heterodera glycines
  Coding regions on vcDNA: vcDNA=SeqID_97022; Strand=+; Position=49-333
INKMSPLRFLAVLLLICAMFSFNNLGLANGEESKDSQVALRPDVAAVQPGPRRCSRSPWLLWRWWRLLRWRLGKKEISSQRRKEGCRQRLIIFN

SEQ ID NO: 170600 - protein, 95 aa, Heterodera glycines
  Coding regions on vcDNA: vcDNA=SeqID_97023; Strand=+; Position=1-288
DEIIKVLREEIDEQHRVHGTRVKVWRERIDSLEQMLISQQERAEADKWSQNGQMKEEGIKNREKQQSEKVLFICEKCLNAFPRYGYLYAHYSNCN

SEQ ID NO: 170601 - protein, 65 aa, Heterodera glycines; identical to SEQ ID NO: 164053
  Coding regions on vcDNA: vcDNA=SeqID_97024; Strand=-; Position=2-196

SEQ ID NO: 170602 - protein, 110 aa, Heterodera glycines
  Coding regions on vcDNA: vcDNA=SeqID_97025; Strand=+; Position=1-333
AVPVPMSVPAKLILLLVAASLVADFVLGMDEQNGAAAGKSSKTPTDPNDKLPKNAEKSNAPMKLTNTKKIDQDKLKGVSKEIKFGDTPPAAATGVPSKKPNSNKNQRGGS

SEQ ID NO: 170603 - protein, 74 aa, Heterodera glycines; identical to SEQ ID NO: 168144
  Coding regions on vcDNA: vcDNA=SeqID_97026; Strand=+; Position=1-225

SEQ ID NO: 170604 - protein, 100 aa, Heterodera glycines
  Coding regions on vcDNA: vcDNA=SeqID_97027; Strand=+; Position=3-302
KVSSTIGRKSPKAMEMKGKIGRRKSNRRRKRKRGNDQTDSLCCDGISYKYPNYPSPLFYGMPSTDRHFVHNFFTFTMKYTHIQYICIQNKQRIEKKKKKK

SEQ ID NO: 170605 - protein, 118 aa, Heterodera glycines; identical to SEQ ID NO: 164058
  Coding regions on vcDNA: vcDNA=SeqID_97028; Strand=-; Position=305-661

SEQ ID NO: 170606 - protein, 105 aa, Heterodera glycines
  Coding regions on vcDNA: vcDNA=SeqID_97029; Strand=+; Position=1-318
HFVRLPKAPPIIHKPSTNNNNMEIPSSNYPPPPPYDSSVLIQQPNNPSPNSPMMEKGPAATTAGICASHRFNTNRPSGEWSGTWSPCSSVSLYRRLPSLCRTGLQ

SEQ ID NO: 170607 - protein, 174 aa, Heterodera glycines
  Homolog annotation: Hit_ID=AAO49799.1; Match level="QueryCoverage =99%, HitCoverage=48%, E-value=3e-92, Identity=94%"; Hit description =arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_97030; Strand=+; Position=2-526
PFNPCLTKENYVEMESKVKAVFEQLKGDAELGGTYYPLQGMTKDVQNQLIADHFLFKEGDRFLQEANACRYWPTGRGIFHNAKKTFLVWVNEEDHLRIISMQNGGNVGQVLERLIKGVKAIESKVPFSRDDRLGWLTFCPTNLGTTVHTSVHIQLPKISTKPNFKSSVDSEQLS

SEQ ID NO: 170608 - protein, 55 aa, Heterodera glycines; identical to SEQ ID NO: 168140
  Coding regions on vcDNA: vcDNA=SeqID_97031; Strand=-; Position=0-164

SEQ ID NO: 170609 - protein, 53 aa, Heterodera glycines; identical to SEQ ID NO: 164311
  Coding regions on vcDNA: vcDNA=SeqID_97032; Strand=+; Position=3-164

SEQ ID NO: 170610 - protein, 80 aa, Heterodera glycines
  Homolog annotation: Hit_ID=NP_497426.1; Match level="QueryCoverage =86%, HitCoverage=45%, E-value=1e-22, Identity=71%"; Hit description =predicted CDS, putative cytoplasmic protein (3C697) [Caenorhabditis elegans] gb|AAK84595.1| Hypothetical
  Coding regions on vcDNA: vcDNA=SeqID_97033; Strand=+; Position=35-277
LVLCTFPHSQFGLHAGENIAVSVAVKDKRCFDRLVVQIERKSTTEKFDVLQCRKCVFNSCWLGSRTLHDQRTYLTNLRSY

SEQ ID NO: 170611 - protein, 74 aa, Heterodera glycines; identical to SEQ ID NO: 168063
  Homolog annotation: Hit_ID=AAH82699.1; Match level="QueryCoverage =55%, HitCoverage=14%, E-value=5e-10, Identity=68%"; Hit description =Unknown (protein for MGC:86260) [Xenopus laevis]
  Gene Ontology: Mol. function=protein binding; Cellular component =cytoplasm; Biological process=signal transduction
  Coding regions on vcDNA: vcDNA=SeqID_97034; Strand=+; Position=93-317

SEQ ID NO: 170612 - protein, 170 aa, Heterodera glycines; identical to SEQ ID NO: 164310
  Homolog annotation: Hit_ID=NP_494804.1; Match level="QueryCoverage =95%, HitCoverage=73%, E-value=3e-59, Identity=64%"; Hit description =SIPL protein like (2E841) [Caenorhabditis elegans] gb|AAC46708.1| Hypothetical protein K07E1.1 [Caenorhab
  Coding regions on vcDNA: vcDNA=SeqID_97035; Strand=+; Position=1-513

SEQ ID NO: 170613 - protein, 83 aa, Heterodera glycines
  Coding regions on vcDNA: vcDNA=SeqID_97036; Strand=+; Position=93-344
GCCCWRSHCAESGWLKAGVDGTKHCGTRSRHSCPGRQSCGQSLASSLSTAVGDRWKEMPNLGGVEKCRNFVANPFHICSLFFF

SEQ ID NO: 170614 - protein, 184 aa, Heterodera glycines
  Homolog annotation: Hit_ID=P21250; Match level="QueryCoverage=96%, HitCoverage=74%, E-value=1e-33, Identity=45%"; Hit description =Immunodominant antigen Ov33-3 precursor
  Coding regions on vcDNA: vcDNA=SeqID_97037; Strand=+; Position=3-554
SKNKLFVNGHFTKDLSEDEQEELKQYQEQLDQFKSKVKTYLEERQKQFRNQVARQGGAEAKEGGTQLKKPEPPKKPSFCSDKATTQYVFDGCSVQGDNVYIGDTFVRKLSPDEQKELAQFDQKFTAYQKAVTAGFRKQVEEMFGQHFSTLFNASNLSPSTADKQQAVPSSNSKLTPTNAENNRH

SEQ ID NO: 170615 - protein, 76 aa, Heterodera glycines; identical to SEQ ID NO: 168133
  misc_feature (10)..(10): Xaa can be any naturally occurring amino acid
  misc_feature (40)..(40): Xaa can be any naturally occurring amino acid
  misc_feature (59)..(59): Xaa can be any naturally occurring amino acid
  misc_feature (62)..(62): Xaa can be any naturally occurring amino acid
  misc_feature (69)..(69): Xaa can be any naturally occurring amino acid
  Coding regions on vcDNA: vcDNA=SeqID_97038; Strand=+; Position=118-348

SEQ ID NO: 170616 - protein, 139 aa, Heterodera glycines; identical to SEQ ID NO: 163805
  Coding regions on vcDNA: vcDNA=SeqID_97039; Strand=+; Position=28-447

SEQ ID NO: 170617 - protein, 72 aa, Heterodera glycines; identical to SEQ ID NO: 168124
  Homolog annotation: Hit_ID=CAE61905.1; Match level="QueryCoverage =87%, HitCoverage=20%, E-value=5e-13, Identity=61%"; Hit description =Hypothetical protein CBG05897 [Caenorhabditis briggsae]
  Coding regions on vcDNA: vcDNA=SeqID_97040; Strand=+; Position=2-220

SEQ ID NO: 170618 - protein, 148 aa, Heterodera glycines
  misc_feature (65)..(65): Xaa can be any naturally occurring amino acid
  Homolog annotation: Hit_ID=ZP_00056387.1; Match level="QueryCoverage =100%, HitCoverage=36%, E-value=5e-66, Identity=81%"; Hit description= COG0538: Isocitrate dehydrogenases [Magnetospirillum magnetotacticum MS-1]
  Gene Ontology: Mol. function=isocitrate dehydrogenase (NADP+) activity; Cellular component=mitochondrion; Biological process =isocitrate metabolism
  Coding regions on vcDNA: vcDNA=SeqID_97041; Strand=+; Position=44-485
MQKIRVANPVVDLDGDEMTRIIWAGIKEKLILPYLDIDIKYYDLSIENRDATDDEVTVDAAEAIXKKYNVGIKCATITADEARVKEFGLKKMWLSPNGTIRNILGGTVFREPIICKNIPRVVPGWKKEIVIGRHAFGDQYKATDIVVP

SEQ ID NO: 170619 - protein, 81 aa, Heterodera glycines
  Coding regions on vcDNA: vcDNA=SeqID_97042; Strand=+; Position=10-255
GGLDPMHSLPSAFCIFTFGILFPPPPKAPRLSAVFNIGPKPTMRWVDFVIGNDIYVTKALKMLCARKKRTQNKCDAKKGAF

SEQ ID NO: 170620 - protein, 123 aa, Heterodera glycines
  misc_feature (39)..(39): Xaa can be any naturally occurring amino acid
  Homolog annotation: Hit_ID=BAA02166.1; Match level="QueryCoverage =51%, HitCoverage=8%, E-value=1e-19, Identity=77%"; Hit description =KIF3 protein [Mus musculus] sp|P28741|KF3A_MOUSE Kinesin-like protein KIF3A (Microtubule plus end-directed
  Gene Ontology: Mol. function=plus-end-directed kinesin ATPase activity; Cellular component=plus-end kinesin complex; Biological process=organelle organization and biogenesis
  Coding regions on vcDNA: vcDNA=SeqID_97043; Strand=+; Position=1-371
AGSERQAKINATGDRLKEASKINLSLSTLGNVISALADXESPHVPYRNSKLNRILQELLGGTAGPTVGAEQPLGKDDKINVSLNAFVGSWQWRRASEHSKQNSATLRSSTAHCRRSPRGWANG

SEQ ID NO: 170621 - protein, 128 aa, Heterodera glycines
  Homolog annotation: Hit_ID=NP_492517.2; Match level="QueryCoverage =74%, HitCoverage=26%, E-value=8e-16, Identity=52%"; Hit description =STomatin-Like (stl-1) [Caenorhabditis elegans] emb|CAB03018.2| Hypothetical protein F30A10.5 [Caenorhabdi
  Gene Ontology: Mol. function=receptor binding; Cellular component =cytoskeleton
  Coding regions on vcDNA: vcDNA=SeqID_97044; Strand=+; Position=98-481
MNMPPEIQRAMKMQVEAERKKRAAILESEGICEAENNRAEGEKQARILRSEAQMQEQMNKSMGLAKAAEAEKIQRILQSEAEMQMKVNMAIGLAKSAESEKESRVILAEAEEQEQVIVSRGLACAIET

SEQ ID NO: 170622 - protein, 134 aa, Heterodera glycines; identical to SEQ ID NO: 164087
  Coding regions on vcDNA: vcDNA=SeqID_97045; Strand=+; Position=2-406

SEQ ID NO: 170623 - protein, 141 aa, Heterodera glycines
  Homolog annotation: Hit_ID=AAO49799.1; Match level="QueryCoverage =97%, HitCoverage=38%, E-value=4e-75, Identity=98%"; Hit description =arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_97046; Strand=+; Position=3-428
VEMESKVKAVFEQLKSDAELGGTYYPLQGMTKDVQNQLIADHFLFKEGDRFLQEANACRYWPTGRGIFHNAKKTFLVWVNEEDHLRIISMQNGGNVGRVLERLIKGVKAIESKVPFSRDDRLGWLTFCPTNLGTTVRWRLR

SEQ ID NO: 170624 - protein, 52 aa, Heterodera glycines
  Coding regions on vcDNA: vcDNA=SeqID_97047; Strand=-; Position=20-178
VYRFLKKKFNDKKCQLVNRSTLNLSPNGTSFSQHAHCGFLMSFELNEKLISI

SEQ ID NO: 170625 - protein, 130 aa, Heterodera glycines
  Homolog annotation: Hit_ID=CAE60078.1; Match level="QueryCoverage =75%, HitCoverage=35%, E-value=1e-23, Identity=50%"; Hit description =Hypothetical protein CBG03598 [Caenorhabditis briggsae]
  Gene Ontology: Mol. function=actin cross-linking activity; Cellular component=actin filament; Biological process=cell organization and biogenesis
  Coding regions on vcDNA: vcDNA=SeqID_97048; Strand=+; Position=153-542
DTKRRMANAEEVCPTYSEAFSHGNDDGSFCTITEFKRNKLETEARKNWDRFYKRNSDNFFKDRNWTKREIEQMCAKDMELSAPLTLLDAGCGCGNTLFPLAKFFPNWTFCGVDFSSNALSLLQQRAVQIG

SEQ ID NO: 170626 - protein, 54 aa, Heterodera glycines
  Coding regions on vcDNA: vcDNA=SeqID_97049; Strand=-; Position=1-162
KYRFFYLTNLRISTSLSFSVSISFYTSSVGQIKPNQIDSSNFTSTAASLASVTI

SEQ ID NO: 170627 - protein, 97 aa, Heterodera glycines; identical to SEQ ID NO: 168118
  Coding regions on vcDNA: vcDNA=SeqID_97050; Strand=-; Position=2-292

SEQ ID NO: 170628 - protein, 100 aa, Heterodera glycines; identical to SEQ ID NO: 162880
  Coding regions on vcDNA: vcDNA=SeqID_97051; Strand=+; Position=163-462

SEQ ID NO: 170629 - protein, 120 aa, Heterodera glycines
  Homolog annotation: Hit_ID=AAN32884.1; Match level="QueryCoverage =100%, HitCoverage=35%, E-value=6e-63, Identity=98%"; Hit description= cellulase ENG-5 [Heterodera glycines] gb|AAP97436.1| cellulase ENG-5 [Heterodera glycines]
  Coding regions on vcDNA: vcDNA=SeqID_97052; Strand=+; Position=18-377
MSAWICPGFLLFFVLILITDHCPMTQAVTQPPYGQLAVSGKNLVQKSTKKAVALHGLSMYCSQCVPKFWVKQTVNKLKCSCNANVVRAAMASSFGGYISNPTAEYKKMTAIIDGAIDQGL

SEQ ID NO: 170630 - protein, 181 aa, Heterodera glycines
  Homolog annotation: Hit_ID=NP_506570.1; Match level="QueryCoverage =98%, HitCoverage=53%, E-value=1e-41, Identity=50%"; Hit description =DeHydrogenase, Short chain (37.2 kD) (dhs-22) [Caenorhabditis elegans] emb|CAB02732.1| Hypothetical prote
  Gene Ontology: Cellular component=nucleus; Biological process =induction of apoptosis
  Coding regions on vcDNA: vcDNA=SeqID_97053; Strand=+; Position=3-545
FVKEFNRDEPKLDILINNAGIMFYPRFTKTVDGHELTWQSNFLGHFLLTELLLPKLERSEEGGRIVNVSSSVHLHADSVDPEVVESPRRFGIIATYARSKLANVMHVVALTKRIRTNDSGSKVSANACHPGSVNTELIRNNFFRKYIKKAFAPIIWFVLKTDRDGAQTPLFLALSRQINGV

SEQ ID NO: 170631 - protein, 148 aa, Heterodera glycines; identical to SEQ ID NO: 164166
  Homolog annotation: Hit_ID=AAO51812.1; Match level="QueryCoverage =62%, HitCoverage=10%, E-value=6e-11, Identity=37%"; Hit description =similar to Homo sapiens (Human). Hypothetical protein FLJ12697 (Fragment) [Dictyostelium discoideum]
  Coding regions on vcDNA: vcDNA=SeqID_97054; Strand=+; Position=3-449

SEQ ID NO: 170632 - protein, 69 aa, Heterodera glycines; identical to SEQ ID NO: 164181
  Coding regions on vcDNA: vcDNA=SeqID_97055; Strand=-; Position=348-557

SEQ ID NO: 170633 - protein, 50 aa, Heterodera glycines
  Homolog annotation: Hit_ID=ZP_00357698.1; Match level="QueryCoverage =78%, HitCoverage=24%, E-value=4e-14, Identity=89%"; Hit description =hypothetical protein Chlo02002738 [Chloroflexus aurantiacus]
  Coding regions on vcDNA: vcDNA=SeqID_97056; Strand=-; Position=1-150
FFFFFFFFFFFFFFFFFFFFFFFFFFFFFFFFFKLKHLLSTNIKINNKCG

SEQ ID NO: 170634 - protein, 83 aa, Heterodera glycines
  Coding regions on vcDNA: vcDNA=SeqID_97057; Strand=-; Position=1-249
GTYTLFNFPRQNKRTSARKQINCLNKFPLVSKRMPFFTQCQRMNGRAFFGRIWRQQRRVQLNQPIWLIGGCSFLGRVNPLIKR

SEQ ID NO: 170635 - protein, 59 aa, Heterodera glycines
  Coding regions on vcDNA: vcDNA=SeqID_97058; Strand=-; Position=2-178
TITTKFQLFKGRFSIESKRLNGRMIPSSIRPSFLSSDAKRSGKVLATTQNRAYIRRNTW

SEQ ID NO: 170636 - protein, 132 aa, Heterodera glycines
  Coding regions on vcDNA: vcDNA=SeqID_97059; Strand=+; Position=2-397
GGNKSRIWQLGSMDPSGQRLDQLLGKESKSNEQKQRISSLFTSVHLFMPKPVVVLYGEELGLLSGKPTANKLANRIVYPWSNETFGNQSQGFFVFPQRTKNGDFESQKNDKHSPLALFKEIAKLREHSDFFS

SEQ ID NO: 170637 - protein, 96 aa, Heterodera glycines; identical to SEQ ID NO: 164303
  Coding regions on vcDNA: vcDNA=SeqID_97060; Strand=+; Position=289-579

SEQ ID NO: 170638 - protein, 114 aa, Heterodera glycines
  Homolog annotation: Hit_ID=CAE67529.1; Match level="QueryCoverage =75%, HitCoverage=16%, E-value=4e-12, Identity=44%"; Hit description =Hypothetical protein CBG13051 [Caenorhabditis briggsae]
  Gene Ontology: Cellular component=ribonucleoprotein complex
  Coding regions on vcDNA: vcDNA=SeqID_97061; Strand=+; Position=32-376
MKLSIILLLSLAFCALIIDAYPSGNGKDLEADNEKTEVKEEKMEKREAEVEEGKKEKKAAEEEVGKKEKRGSGGGTWGNGGRGNGGGNGGGGHGGGGHGGGHGGGNDSSGGGDD

SEQ ID NO: 170639 - protein, 50 aa, Heterodera glycines
  Coding regions on vcDNA: vcDNA=SeqID_97062; Strand=-; Position=1-150
FFFFFFFFFFFFFFFFFFFFFFLKALRYFIQIFTRHEKRCRAKSIKVVFN

SEQ ID NO: 170640 - protein, 76 aa, Heterodera glycines; identical to SEQ ID NO: 129528
  Coding regions on vcDNA: vcDNA=SeqID_97063; Strand=+; Position=89-319

SEQ ID NO: 170641 - protein, 171 aa, Heterodera glycines
  Homolog annotation: Hit_ID=NP_509391.1; Match level="QueryCoverage =94%, HitCoverage=74%, E-value=1e-37, Identity=43%"; Hit description =placental protein 11 like precursor (62.8 kD) (XI865) [Caenorhabditis elegans] gb|AAF99995.2| Hypothetica
  Gene Ontology: Mol. function=serine-type peptidase activity; Cellular component=extracellular space; Biological process=proteolysis and peptidolysis
  Coding regions on vcDNA: vcDNA=SeqID_97064; Strand=+; Position=317-829
GKVDGLDFDAFTRQLFDRWFGAYTRCGTCKNGKCSRHGGPLGSSGWEHVFSGEWRGEIVDGHHSWVRFYLQEKAGDIEYHGYYVKPRHGQFIGTIQYKWKQYLKRIGGFMIGTSPAFDFSLLTVCILTEPGDRKCKFQLKETPMFVSSFLEDCVIDGSFRHNFCIATAYPG

SEQ ID NO: 170642 - protein, 63 aa, Heterodera glycines
  Coding regions on vcDNA: vcDNA=SeqID_97065; Strand=-; Position=73-264
VPENVTMCIKQSRELDDLTKFESEKFFQLYELRKLIFLVTKNEFLYPNITNNCQSVCFCWWRS

SEQ ID NO: 170643 - protein, 129 aa, Heterodera glycines
  Homolog annotation: Hit_ID=CAE63795.1; Match level="QueryCoverage =98%, HitCoverage=83%, E-value=4e-14, Identity=41%"; Hit description =Hypothetical protein CBG08337 [Caenorhabditis briggsae]
  Gene Ontology: Mol. function=carboxypeptidase activity; Cellular component=mitochondrial inner membrane; Biological process=transport
  Coding regions on vcDNA: vcDNA=SeqID_97066; Strand=+; Position=3-389
ADSADDSLWSRYHDQNAMEELLEKVHSKCPNVTRLYSVGRSVQGRDLAVIEFSLHPGRHQILKPEMVSDARNGEPIANAVVWVRNVTDGDGQTAIKHPVTTWITGDYFRPLVSGCYQIAVEADGYEIGI

SEQ ID NO: 170644 - protein, 148 aa, Heterodera glycines; identical to SEQ ID NO: 164141
  Homolog annotation: Hit_ID=AAP41028.1; Match level="QueryCoverage =100%, HitCoverage=36%, E-value=3e-80, Identity=100%"; Hit description=arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_97067; Strand=+; Position=3-449

SEQ ID NO: 170645 - protein, 195 aa, Heterodera glycines
  Homolog annotation: Hit_ID=CAE62912.1; Match level="QueryCoverage =100%, HitCoverage=36%, E-value=2e-32, Identity=42%"; Hit description= Hypothetical protein CBG07104 [Caenorhabditis briggsae]
  Gene Ontology: Mol. function=protein kinase binding; Cellular component=cytoplasm; Biological process=regulation of JNK cascade
  Coding regions on vcDNA: vcDNA=SeqID_97068; Strand=+; Position=2-586
YYEDADGLNGNLSYGGTKGRKEWEENADPHSSDLSLYNIADGNKSSSGISSCCTTSSRSCEPPETNRFVLAKKQRHFKAGDEADPKMPTHRAQFPFMPRHSEQIELQKGDAIRILEKYEDHWCHGINLRSGKKGIFPEAHVVEIDLVDEICRSVLPDGTNHANKIERDTFYLTMLASIEVAHHRGNDVVMQAINK

SEQ ID NO: 170646 - protein, 40 aa, Heterodera glycines; identical to SEQ ID NO: 168110
  Coding regions on vcDNA: vcDNA=SeqID_97069; Strand=+; Position=49-171

SEQ ID NO: 170647 - protein, 169 aa, Heterodera glycines; identical to SEQ ID NO: 164297
  Coding regions on vcDNA: vcDNA=SeqID_97070; Strand=+; Position=3-509

SEQ ID NO: 170648 - protein, 130 aa, Heterodera glycines
  Coding regions on vcDNA: vcDNA=SeqID_97071; Strand=+; Position=1-390
PRRCPKYAIVRLTEGTNVLQFYQLLLDNGQEEVSFVNEMRENAFQLYEKPNNDTGKDEASIAADTGAGKKKLPDAEQKQTTDTKERKSPIMVDKGVQVIPERTIFASPSFSSSFRTQLPASPILRTAKKE

SEQ ID NO: 170649 - protein, 160 aa, Heterodera glycines
  Homolog annotation: Hit_ID=CAE75284.1; Match level="QueryCoverage =65%, HitCoverage=45%, E-value=4e-23, Identity=49%"; Hit description =Hypothetical protein CBG23251 [Caenorhabditis briggsae]
  Coding regions on vcDNA: vcDNA=SeqID_97072; Strand=-; Position=1-498
MNDENNGNQMNFFVQNLLFKAHTFCFSTFIPFIHSIHLIIRPPPPPRQIETSRSLFPYRRYYYSDYISNPYYWSSSYSYWGRYRSYLSDYDWPSYYNRWYDPYYDSYSRTYRYRSWLLDSMEDSLSKGLAQYRQGTINYNQLYRYRSYLSDYDWPSYYNR

SEQ ID NO: 170650 - protein, 39 aa, Heterodera glycines; identical to SEQ ID NO: 167895
  Coding regions on vcDNA: vcDNA=SeqID_97073; Strand=+; Position=91-210

SEQ ID NO: 170651 - protein, 144 aa, Heterodera glycines
  Coding regions on vcDNA: vcDNA=SeqID_97074; Strand=-; Position=99-533
GTYIASGDADGFLFVWKLEQEVLECEVQMLEEPATVRQRDADPEMDIPPNKENWARAFRSPIRHDGDVTGISWSPDSQMLASVSMDDSVAVHRADNGSSNGYFGRNERHKTSLLPPNRISINSPSSGRQFRNSSKSKTCHNYSY

SEQ ID NO: 170652 - protein, 36 aa, Heterodera glycines
  Coding regions on vcDNA: vcDNA=SeqID_97075; Strand=+; Position=3-113
LKNRHSFGHFEPQRILVPYNESEKGFYFYKTFNIFE

SEQ ID NO: 170653 - protein, 83 aa, Heterodera glycines
  Coding regions on vcDNA: vcDNA=SeqID_97076; Strand=+; Position=1-252
LFFRIRRIFYENYIKFIMAAAKAGITKYELIGVSSLSFLAVFVAILILLVQMLFHKAKMQTEEAECVHIDHQLQQKKKKNERF

SEQ ID NO: 170654 - protein, 151 aa, Heterodera glycines
  Homolog annotation: Hit_ID=AAO49799.1; Match level="QueryCoverage =100%, HitCoverage=60%, E-value=7e-62, Identity=93%"; Hit description= arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_97077; Strand=+; Position=1-456
KENYVEMESKVKAVFEQLEGDAELGGTYYPLQGNVGQVLERLIEGVKAIESKVPFSRDDRLGWLTFCPTNLGTTVRASVHIRLPKISAKPDFKSTCDGLKLQIRGIHGEHSESAGGVYDISNKARLGLTEFEAVKQMYDGVKHLIELEKKA

SEQ ID NO: 170655 - protein, 142 aa, Heterodera glycines
  Coding regions on vcDNA: vcDNA=SeqID_97078; Strand=+; Position=125-550
GESVENFFYNKMMNKIYATIHFLLLLTVIANKSTNCATNGQGTQTVKTADATHDEAGKISRDSSSSSDEDDSTTAASKMLLNEANNAFSKDNDEPINQQQKMRPEANFSVKYLPPRLNAAQIDNIAQQASSMITLRTLKHVK

SEQ ID NO: 170656 - protein, 42 aa, Heterodera glycines
  Coding regions on vcDNA: vcDNA=SeqID_97079; Strand=-; Position=1-126
VIPALKMHRIIAAVKKLVVGSVLAVRCTLCVLLVWLAFLPAA

SEQ ID NO: 170657 - protein, 84 aa, Heterodera glycines; identical to SEQ ID NO: 164165
  Homolog annotation: Hit_ID=AAP30776.1; Match level="QueryCoverage =84%, HitCoverage=24%, E-value=4e-18, Identity=67%"; Hit description =putative gland protein G34B08 [Heterodera glycines]
  Coding regions on vcDNA: vcDNA=SeqID_97080; Strand=+; Position=65-319

SEQ ID NO: 170658 - protein, 87 aa, Heterodera glycines; identical to SEQ ID NO: 164187
  Homolog annotation: Hit_ID=AAL78212.1; Match level="QueryCoverage =66%, HitCoverage=63%, E-value=7e-17, Identity=55%"; Hit description =putative esophageal gland cell secretory protein Hgg-25 [Heterodera glycines]
  Coding regions on vcDNA: vcDNA=SeqID_97081; Strand=+; Position=67-330

SEQ ID NO: 170659 - protein, 42 aa, Heterodera glycines; identical to SEQ ID NO: 164080
  Coding regions on vcDNA: vcDNA=SeqID_97082; Strand=+; Position=63-191

SEQ ID NO: 170660 - protein, 66 aa, Heterodera glycines; identical to SEQ ID NO: 138838
  Coding regions on vcDNA: vcDNA=SeqID_97083; Strand=-; Position=50-250

SEQ ID NO: 170661 - protein, 51 aa, Heterodera glycines
  Homolog annotation: Hit_ID=AAN32884.1; Match level="QueryCoverage =100%, HitCoverage=15%, E-value=1e-23, Identity=98%"; Hit description= cellulase ENG-5 [Heterodera glycines] gb|AAP97436.1| cellulase ENG-5 [Heterodera glycines]
  Coding regions on vcDNA: vcDNA=SeqID_97084; Strand=+; Position=248-400
GLPMFVTEYGCYSADGNEKANLEELKKWMELLDGYGISYAAWHVADIGEQS

SEQ ID NO: 170662 - protein, 99 aa, Heterodera glycines
  Coding regions on vcDNA: vcDNA=SeqID_97085; Strand=-; Position=83-382
MVYDIVRCVQVESKSIAAVIHHQNCGCSFSQHSDDGLNDPFAGHGQTAPFLDQLGHLGLAVRLRQQHINGRLNFGTEFHLFLKVSARFGGKRFTRTNAD

SEQ ID NO: 170663 - protein, 43 aa, Heterodera glycines
  Coding regions on vcDNA: vcDNA=SeqID_97086; Strand=+; Position=39-170
QICPRKWPNLATSSIFSRKLRIFRSGGADRRRREIFKNFKAIY

SEQ ID NO: 170664 - protein, 79 aa, Heterodera glycines
  Homolog annotation: Hit_ID=AAA73456.2; Match level="QueryCoverage =100%, HitCoverage=66%, E-value=1e-32, Identity=86%"; Hit description= beta-galactosidase alpha peptide [Cloning vector pSport1]
  Coding regions on vcDNA: vcDNA=SeqID_97087; Strand=+; Position=2-524
TPSSNFTHYRESWYVCRYRSGIPGTLRCYHLVVVGGRSRGSKLTYACMRRHSSSIVSPKFNSLAVVLQRRDWENPGVTQ

SEQ ID NO: 170665 - protein, 182 aa, Heterodera glycines
  Coding regions on vcDNA: vcDNA=SeqID_97088; Strand=+; Position=3-548
NSFFLKMLSAAFFMPLFFIAIGQFLQISDAIDCFSCASPALHNQWEATGLPEIPPPDRFAFHACDGTGTDYKPCADVCMEMLVAAGNEYGVVRGCMSDFYHGQTTSTNTDKCYFGGYPHNVTIYDPTNGAKTYSQLYVGVRYCSTVNGACNNKFMAKKEAAEGSGLLPKHFVVRPNKCQQRL

SEQ ID NO: 170666 - protein, 109 aa, Heterodera glycines
  Homolog annotation: Hit_ID=NP_496560.1; Match level="QueryCoverage =96%, HitCoverage=46%, E-value=2e-11, Identity=30%"; Hit description =prevents mitotic catastrophe 2 homolog (30.3 kD) (2M315) [Caenorhabditis elegans] emb|CAA19458.1| Hypothe
  Coding regions on vcDNA: vcDNA=SeqID_97089; Strand=+; Position=214-540
MTTNWEKLRKELNETEEKGKGNSKKRKRKVSENCNNKWKKMREEIEKNDQQKPEKAIETTISAKKILMAIDCEYVGVGLNGAENMLARVSIVDAEGIAVYDKYVKPTEE

SEQ ID NO: 170667 - protein, 127 aa, Heterodera glycines
  Coding regions on vcDNA: vcDNA=SeqID_97090; Strand=+; Position=2-382
FHWKEPKKAHPFPDSVVLKIPGPKYNSLVAQNGREEQTDNAMEEESSDYLIKAHTNEILFYKNFPRFDASLRLPKFYFGSDYSPSHNNGLIIMEDLSSRASSLLTLPGFDDAHVLVVIDELSKIHAI

SEQ ID NO: 170668 - protein, 64 aa, Heterodera glycines; identical to SEQ ID NO: 139695
  Coding regions on vcDNA: vcDNA=SeqID_97091; Strand=-; Position=1-192

SEQ ID NO: 170669 - protein, 132 aa, Heterodera glycines
  Homolog annotation: Hit_ID=NP_704944.1; Match level="QueryCoverage =87%, HitCoverage=55%, E-value=1e-19, Identity=42%"; Hit description =small heat shock protein, putative [Plasmodium falciparum 3D7] emb|CAD52179.1| small heat shock protein,
  Gene Ontology: Biological process=protein kinase cascade
  Coding regions on vcDNA: vcDNA=SeqID_97092; Strand=+; Position=1-399
QRLFPELQTLSRLSDPFESEFRSLRQFSQLPAIDVNETKEAFVVHADIPGFTREEIDISLNGPVLALKGNKEKKEEKKDETQHIQERIQSSFYRSITLPETFAPENVKASLKDGILEITIPKNAVTKKITIS

SEQ ID NO: 170670 - protein, 49 aa, Heterodera glycines
  Coding regions on vcDNA: vcDNA=SeqID_97093; Strand=+; Position=69-218
KKIGKITGMLLEMENAEIVLLLGDEEMLRLRVDEAATVLYQATCHKEAQ

SEQ ID NO: 170671 - protein, 284 aa, Heterodera glycines
  Homolog annotation: Hit_ID=AAC48327.1; Match level="QueryCoverage =68%, HitCoverage=40%, E-value=1e-106, Identity=100%"; Hit description=beta-1,4-endoglucanase-1 precursor [Heterodera glycines] gb|AAC15707.1| beta-1,4-endoglucanase-1 precurs
  Gene Ontology: Mol. function=glucosidase activity; Cellular component= cell wall (sensu Fungi); Biological process=cell wall organization and biogenesis
  Coding regions on vcDNA: vcDNA=SeqID_97094; Strand=+; Position=3-854
CRLQATHLLARLFLLFALCTAFVSSLTAVAPPFGQLSVSDTNLVGANGQPVQLIGNSLFWHQWYPQFWNADTVKALKCNWNANVIRGAMGVDVASQNPIKDYQNLMYTLHFYASSHFTNDLGAKLKTAVNNGLPVFVTEYGTCEASGNGNLNTDSMSSWWTLLDSLKISYANWAISDKSEACSALSPGTTAANVGVSSRWTSSGNMVASYYKKKSTGVSCSGSSSGSSSGSSSGSSGSSSGSSSGSSSGSSSGSSSGSSGSSSGSSSGSGSASISVVPSNTWNG

SEQ ID NO: 170672 - protein, 151 aa, Heterodera glycines
  Coding regions on vcDNA: vcDNA=SeqID_97095; Strand=+; Position=3-455
PHLPTNSPISEANNYSYLPLLLLQKEDQKWKHPLKLTKYTGHMKPEFTKPFLIRFPNQFIAKTKEGTEQKESSQHRKVNRTGKEYTSHGAILVKRPSSSLTVMNMICLRRFTGKFAVNCQIFGAPLGSPISAADSSSPLLRPEERQREENF

SEQ ID NO: 170673 - protein, 141 aa, Heterodera glycines
  misc_feature (93)..(93): Xaa can be any naturally occurring amino acid
  Homolog annotation: Hit_ID=NP_965735.1; Match level="QueryCoverage =95%, HitCoverage=76%, E-value=1e-34, Identity=55%"; Hit description =hypothetical protein LJ0520 [Lactobacillus johnsonii NCC 533] gb|AAS09701.1| hypothetical protein LJ0520
  Coding regions on vcDNA: vcDNA=SeqID_97096; Strand=+; Position=3-429
IHRAAGPQLLEECRTLKGCEVGEAKITKAYNLMPNIKAIIHTVGPQIGTEVSDEQCRQLRDCYANSLSLARDNKLRSIAFPCISTGVYNFPKXEASEIAIKTVRDWLTEGQNNEKLDTVIFCVFGDDDLGFYEKNIPQFIL

SEQ ID NO: 170674 - protein, 209 aa, Heterodera glycines; identical to SEQ ID NO: 163937
  Homolog annotation: Hit_ID=NP_492659.1; Match level="QueryCoverage =95%, HitCoverage=98%, E-value=4e-33, Identity=38%"; Hit description =putative protein (24.8 kD) (1K653) [Caenorhabditis elegans] emb|CAB05896.1| Hypothetical protein B0379.1
  Coding regions on vcDNA: vcDNA=SeqID_97097; Strand=+; Position=87-716

SEQ ID NO: 170675 - protein, 44 aa, Heterodera glycines
  misc_feature (19)..(19): Xaa can be any naturally occurring amino acid
  Homolog annotation: Hit_ID=AAA73456.2; Match level="QueryCoverage =70%, HitCoverage=27%, E-value=7e-09, Identity=90%"; Hit description =beta-galactosidase alpha peptide [Cloning vector pSport1]
  Coding regions on vcDNA: vcDNA=SeqID_97098; Strand=+; Position=1-134
TMITPSSNTPHYRESWYAXPYRSGIPGSTSSSSWPLIRLTIGGC

SEQ ID NO: 170676 - protein, 43 aa, Heterodera glycines; identical to SEQ ID NO: 164108
  Coding regions on vcDNA: vcDNA=SeqID_97099; Strand=+; Position=1-132

SEQ ID NO: 170677 - protein, 103 aa, Heterodera glycines
  Homolog annotation: Hit_ID=NP_501176.1; Match level="QueryCoverage =93%, HitCoverage=25%, E-value=2e-14, Identity=43%"; Hit description =membrane interacting protein of RGS16 family member (40.7 kD) (4I141) [Caenorhabditis elegans] gb|AAD1473
  Coding regions on vcDNA: vcDNA=SeqID_97100; Strand=+; Position=85-393
MTQSPRPAYVSSLLLLFPIFLLPYAVIFFIVVSFFLFLHFRNLPSPANNVANFFRGFHLGGHRGSPTNAPENTIASFKQALAEGVDFVEFDIGLTADGVPVLM

SEQ ID NO: 170678 - protein, 145 aa, Heterodera glycines
  misc_feature (42)..(42): Xaa can be any naturally occurring amino acid
  Homolog annotation: Hit_ID=NP_503545.1; Match level="QueryCoverage =100%, HitCoverage=36%, E-value=4e-42, Identity=54%"; Hit description= ALDH3C2, ALdehyde deHydrogenase (48.8 kD) (alh-5) [Caenorhabditis elegans] gb|AAB94178.1| Aldehyde dehyd
  Gene Ontology: Mol. function=aldehyde dehydrogenase activity; Cellular component=integral to membrane; Biological process =acetaldehyde metabolism
  Coding regions on vcDNA: vcDNA=SeqID_97101; Strand=+; Position=3-436
EKAALRIAEGKWLNSGQTCLAPDYVMTTAEMKPKLVNALQKXQYSRMVNQLHFDRVKALLDKTNGKVLYKNGEPDRDDVFIPPVLVDTDLKDALMQEEVFGPVLPILTVKGLDEAMDVINDGEKPLGAYLFTNDQQKVDKFLNET

SEQ ID NO: 170679 - protein, 48 aa, Heterodera glycines
  Coding regions on vcDNA: vcDNA=SeqID_97102; Strand=-; Position=2-145
ANKMRQILKTNTFYTAKEFIVGYYPICHSFCPQSTLRPSPHFSACSHC

SEQ ID NO: 170680 - protein, 168 aa, Heterodera glycines
  Homolog annotation: Hit_ID=NP_510634.1; Match level="QueryCoverage =42%, HitCoverage=21%, E-value=4e-12, Identity=49%"; Hit description =misexpression suppressor of KSR (35.6 kD) (XQ738) [Caenorhabditis elegans] emb|CAA92227.1| Hypothetical p
  Coding regions on vcDNA: vcDNA=SeqID_97103; Strand=+; Position=39-542
GKLVRLQVPVRNSRVDIIIIIMAANTTHYRGIFLFFLFSFTLRFRKMSNLNFEDNLQRVQVEIQWKQCLCNPIVAPFADVGSYPIFTDEFKGTRKCTLDVYVQGNLEHLDDKVVFLTVHDVGKTYLSCVDLANSPTLSPLVGQRAVFLHVSVPGQAPGAENFVGDFPS

SEQ ID NO: 170681 - protein, 141 aa, Heterodera glycines
  Homolog annotation: Hit_ID=AAA73456.2; Match level="QueryCoverage =21%, HitCoverage=27%, E-value=1e-11, Identity=100%"; Hit description= beta-galactosidase alpha peptide [Cloning vector pSport1]
  Coding regions on vcDNA: vcDNA=SeqID_97104; Strand=+; Position=1-423
TMITPSSNTTHYRESWYACRYRSGIPGSTSSSSWPLIRLTIGVSFTLRFRKMSNLNFEDNLQRVQVEIQWKQCLYNPIVAPFADVGSYPIFTDEFKGTRKCTLDVYVQGNLEHLDDKVVFLTVHDVGKTYLSCVDLANSPT

SEQ ID NO: 170682 - protein, 35 aa, Heterodera glycines
  Coding regions on vcDNA: vcDNA=SeqID_97105; Strand=+; Position=122-226
FILKDGKSIRSYFTNSDKNLLKNGMKLRKCGLAKG

SEQ ID NO: 170683 - protein, 37 aa, Heterodera glycines
  Coding regions on vcDNA: vcDNA=SeqID_97106; Strand=+; Position=99-212
FSSTFSQKILTRCCGVPKYSKNSVFNPVVLILHYTCF

SEQ ID NO: 170684 - protein, 82 aa, Heterodera glycines; identical to SEQ ID NO: 168075
  Coding regions on vcDNA: vcDNA=SeqID_97107; Strand=-; Position=2-247

SEQ ID NO: 170685 - protein, 38 aa, Heterodera glycines; identical to SEQ ID NO: 164252
  Homolog annotation: Hit_ID=NP_493387.1; Match level="QueryCoverage =100%, HitCoverage=14%, E-value=4e-13, Identity=89%"; Hit description= protein YR-29 (29.7 kD) (1O220) [Caenorhabditis elegans] emb|CAB04941.1| Hypothetical protein W09C5.1 [C
  Gene Ontology: Cellular component=nucleus; Biological process =ribosomal large subunit biogenesis
  Coding regions on vcDNA: vcDNA=SeqID_97108; Strand=+; Position=2-118

SEQ ID NO: 170686 - protein, 179 aa, Heterodera glycines
  Homolog annotation: Hit_ID=CAE59908.1; Match level="QueryCoverage =77%, HitCoverage=19%, E-value=1e-44, Identity=67%"; Hit description =Hypothetical protein CBG03392 [Caenorhabditis briggsae]
  Gene Ontology: Mol. function=NAD+ synthase (glutamine-hydrolyzing) activity; Biological process=nucleobase, nucleoside, nucleotide and nucleic acid metabolism
  Coding regions on vcDNA: vcDNA=SeqID_97109; Strand=+; Position=4-540
MITPSSNTSHYRESWYACTYRSGIPGSTLSSWPLIRLTIGDFTPSYESSDLREGMALQNVQARARMVLAYLHAQLTLTKERRKGSLLILGASNVDESLVGYVTKYDCSSADINPIGATSKDDLREFLCHANANHKFPHLQSVIHSVPTAELRPLKDGQIVQTDEAEIGLTYRELSTFGK

SEQ ID NO: 170687 - protein, 48 aa, Heterodera glycines
  Coding regions on vcDNA: vcDNA=SeqID_97110; Strand=+; Position=1-147
FPQPHVPSDHIPIMSQYAVIPPNFQRSLPPIHHYGGSAHSGGFGAIGR

SEQ ID NO: 170688 - protein, 91 aa, Heterodera glycines
  Coding regions on vcDNA: vcDNA=SeqID_97111; Strand=+; Position=122-394
AAPVRPDSGMGSDELSGGWVGRFMCQTLDKYINSMTMLMSPFSSLSIVPVLPASLPASSVCKWVDFTNKHGFGVTFRDGTRSLLFNDQSSL

SEQ ID NO: 170689 - protein, 130 aa, Heterodera glycines
  Coding regions on vcDNA: vcDNA=SeqID_97112; Strand=+; Position=3-392
NPPNLNRSFIDGNNLQQFSRSASCQQFTTLAKTVPQQPTVSKDSPPPKQPPSAHDSGMGSDELSGGWVGRFMCQTLDKYINPMTMLMSPFSSLSIVPVLPASLPASSVCKWVDFTNKHGFGVTFRDGTRS

SEQ ID NO: 170690 - protein, 69 aa, Heterodera glycines; identical to SEQ ID NO: 168064
  Coding regions on vcDNA: vcDNA=SeqID_97113; Strand=+; Position=1-210

SEQ ID NO: 170691 - protein, 151 aa, Heterodera glycines
  misc_feature (56)..(56): Xaa can be any naturally occurring amino acid
  Homolog annotation: Hit_ID=CAE69126.1; Match level="QueryCoverage =92%, HitCoverage=28%, E-value=7e-60, Identity=77%"; Hit description =Hypothetical protein CBG15152 [Caenorhabditis briggsae]
  Gene Ontology: Mol. function=pre-mRNA splicing factor activity; Cellular component=nucleus; Biological process=mRNA processing
  Coding regions on vcDNA: vcDNA=SeqID_97114; Strand=+; Position=22-476
GDRAQSPRNKPTGAIPRATLQSSVPVVGPSVTCQARRLYVGNIPFGSNEDAMLDFXNQQMHLCGLAQAPGNPVIACQINLDKNFAFIEFRSIDETTAGMAFDGINFMGQQLKIRRPRDYVAPTANYELLGRMPVSNIVVDSPFKLYIGGTP

SEQ ID NO: 170692 - protein, 88 aa, Heterodera glycines; identical to SEQ ID NO: 163701
  Homolog annotation: Hit_ID=CAE63753.1; Match level="QueryCoverage =100%, HitCoverage=20%, E-value=2e-32, Identity=78%"; Hit description= Hypothetical protein CBG08288 [Caenorhabditis briggsae]
  Gene Ontology: Mol. function=transcription co-repressor activity; Cellular component=cytoplasm; Biological process=small GTPase mediated signal transduction
  Coding regions on vcDNA: vcDNA=SeqID_97115; Strand=-; Position=541-807

SEQ ID NO: 170693 - protein, 163 aa, Heterodera glycines
  Coding regions on vcDNA: vcDNA=SeqID_97116; Strand=+; Position=9-500
NILSNYIINLISNKYCRFSQAVVACTAEDPQAQLVSIWDEAENRLISQIITRPLARSLQTYNLASPIFNTFWIGLRRVLVGNRYQSTWTNGSAAIFGNVPEITTAASRNTSPWAAGQPSGTNKYTDPTGAKEECVHMLNAEGRWNDARCEIQMTGAICKKSNF

SEQ ID NO: 170694 - protein, 107 aa, Heterodera glycines
  Coding regions on vcDNA: vcDNA=SeqID_97117; Strand=-; Position=6-329
QQPICSVSLNCECQVHPKKPRNNLCRRKTMRFRPNLAISIFYSLRIGFCETLNFSNPIPARSVPDHNLSFSFIKNLFYMLHRRHPSRPNCHHRSNDALPLDDLVPES

SEQ ID NO: 170695 - protein, 85 aa, Heterodera glycines; identical to SEQ ID NO: 164118
  Coding regions on vcDNA: vcDNA=SeqID_97118; Strand=-; Position=0-254

SEQ ID NO: 170696 - protein, 131 aa, Heterodera glycines
  Homolog annotation: Hit_ID=AAP30835.1; Match level="QueryCoverage =91%, HitCoverage=83%, E-value=2e-64, Identity=94%"; Hit description =putative gland protein G33E05; Hg-G33E05 [Heterodera glycines]
  Coding regions on vcDNA: vcDNA=SeqID_97119; Strand=+; Position=82-474
MRTFLFIAVVGLVLAVIMESVNATGNNSPTYGQTPPGSPKGGHGSNKSPTTPHSAGSPHGTQHGNQQNHATGQTPPGSPKGGHGNNKSPTTPHSAGSPHGTQHGNQQKNATGQSPPDSTKRETELIIEKVS

SEQ ID NO: 170697 - protein, 162 aa, Heterodera glycines; identical to SEQ ID NO: 164247
  Homolog annotation: Hit_ID=AAP30835.1; Match level="QueryCoverage =100%, HitCoverage=100%, E-value=7e-94, Identity=72%"; Hit description=putative gland protein G33E05; Hg-G33E05 [Heterodera glycines]
  Gene Ontology: Cellular component=extracellular space
  Coding regions on vcDNA: vcDNA=SeqID_97120; Strand=+; Position=66-551

SEQ ID NO: 170698 - protein, 98 aa, Heterodera glycines
  Homolog annotation: Hit_ID=NP_493587.1; Match level="QueryCoverage =56%, HitCoverage=36%, E-value=6e-21, Identity=78%"; Hit description =ubiquitin conjugating enzyme (16.9 kD) (ubc-16) [Caenorhabditis elegans] emb|CAA21716.1| Hypothetical pro
  Coding regions on vcDNA: vcDNA=SeqID_97121; Strand=+; Position=3-296
GQLIANFYIHFRNTLYDSEIFQLQFRFDDQYPFSSPEVMFMGENIPVHPHVYSNGHICLSILSDDWTPVTLAVHKMTDNPQTVFFFLGSQRLFRLFVH

SEQ ID NO: 170699 - protein, 113 aa, Heterodera glycines
  Coding regions on vcDNA: vcDNA=SeqID_97122; Strand=+; Position=1-342
HQKDPEVSWRNDATEGVLGKLTTTMGPCFCKGTAYLIHSFLNASHTGGIALIQSICRQIDQKKSPITTSECEKFESNLFGSTIKMAIELTGDDVMCELVAGPWSMSTFFLFLK

SEQ ID NO: 170700 - protein, 130 aa, Heterodera glycines
  Homolog annotation: Hit_ID=CAE67840.1; Match level="QueryCoverage =96%, HitCoverage=56%, E-value=8e-18, Identity=33%"; Hit description =Hypothetical protein CBG13426 [Caenorhabditis briggsae]
  Coding regions on vcDNA: vcDNA=SeqID_97123; Strand=+; Position=2-391
NNYNVIKSGNVKMTTTNPNYDKPLCLNGLSQYEALPSSLCNLNLCNFIGRNLCELLQQPGNHTVREMEQKAGWNATVVMPDSPRIFGIPFVDLFAGEFNFEFLLETEGKEIAHLEVPTNLAFVPIGMQNE

SEQ ID NO: 170701 - protein, 119 aa, Heterodera glycines; identical to SEQ ID NO: 164100
  Coding regions on vcDNA: vcDNA=SeqID_97124; Strand=+; Position=67-426

SEQ ID NO: 170702 - protein, 129 aa, Heterodera glycines
  misc_feature (37)..(37): Xaa can be any naturally occurring amino acid
  misc_feature (66)..(66): Xaa can be any naturally occurring amino acid
  Homolog annotation: Hit_ID=AAC15708.1; Match level="QueryCoverage =96%, HitCoverage=32%, E-value=7e-49, Identity=82%"; Hit description =beta-1,4-endoglucanase-2 precursor [Heterodera glycines]
  Coding regions on vcDNA: vcDNA=SeqID_97125; Strand=+; Position=2-389
SSHFVDGLGNKLKTAVNKGNHLILYRPKPLLFATVLXGLPVFVTEYGTCEASGNGNLNSGSMSSCXSLLDQLKISYVNWSITDKSEACAALTGGTSAANVGTSSRWTQSGNMVASQHKKKSTGLSDQLN

SEQ ID NO: 170703 - protein, 110 aa, Heterodera glycines
  Coding regions on vcDNA: vcDNA=SeqID_97126; Strand=+; Position=50-382
MEVSSMSEKNLKTPKAFRKGEHVPSEKMPGSNERTRGGGGSPSPFPSSSLPRGGRNPFKGISSRIVERVRRSLSRSKKNLSRDGGQSRDGTPSQNTIGIKAGGEVREEVD

SEQ ID NO: 170704 - protein, 67 aa, Heterodera glycines
  Homolog annotation: Hit_ID=AAA73456.2; Match level="QueryCoverage =100%, HitCoverage=52%, E-value=1e-19, Identity=74%"; Hit description= beta-galactosidase alpha peptide [Cloning vector pSport1]
  Coding regions on vcDNA: vcDNA=SeqID_97127; Strand=+; Position=6-491
ITPSSNTSHYRESWYAFPYRAGIPGSTSSSWPLIRLTIGARRSRGSKLTYACMRRHSSSIGSPKFNS

SEQ ID NO: 170705 - protein, 82 aa, Heterodera glycines; identical to SEQ ID NO: 167256
  Coding regions on vcDNA: vcDNA=SeqID_97128; Strand=-; Position=41-289

SEQ ID NO: 170706 - protein, 114 aa, Heterodera glycines
  Coding regions on vcDNA: vcDNA=SeqID_97129; Strand=+; Position=3-344
LALAHKMPQKCRHFGHFPKSLIDLPFLSPNYPNGSLTQRIITMPITEKRVPLRMKRRKSKIHSRNVLRTPLIIPELELMKKWRNSRRNDEKPRGELPSQGEDEAIKLLLLNDIG

SEQ ID NO: 170707 - protein, 141 aa, Heterodera glycines
  Homolog annotation: Hit_ID=AAP30835.1; Match level="QueryCoverage =99%, HitCoverage=91%, E-value=3e-51, Identity=59%"; Hit description =putative gland protein G33E05; Hg-G33E05 [Heterodera glycines]
  Coding regions on vcDNA: vcDNA=SeqID_97130; Strand=+; Position=75-497
MRTFLFIAVVGLVLAVIMERVNATGNNSPTKGQTPPGSPKGGHGNNKSPTTPHSAGSPHGTQHGNQQKNATGQTPPGSPKGGHGNNKSPTTPHSTKRETELIIEKGKPSPDSPNHKNDHENEISNLQNRATGQSPPDSTKR

SEQ ID NO: 170708 - protein, 68 aa, Heterodera glycines
  Coding regions on vcDNA: vcDNA=SeqID_97131; Strand=-; Position=1-204
AEKASLYLVGFVRVHFRFQVKEATFWMTDNEFRLDWSHLAPKSYNSMLNVSLFRHFILLLRHWFFPSF

SEQ ID NO: 170709 - protein, 179 aa, Heterodera glycines
  Coding regions on vcDNA: vcDNA=SeqID_97132; Strand=+; Position=2-538
RKINENSELHSKLFDVERRFDEAVTAFTRRIDELEKENDALKSLVSIPFDAEQRKEFGESENTAPGQTLQQTEANSEEKNAPSAVVPKTDSADDLLGCSSAFANESADLCSRKPSAIAKDEAVEEMAAEKYSTERIAALGESLRHAKGRATYYKQECEELLRKAICDQQRIEALEQNIF

SEQ ID NO: 170710 - protein, 114 aa, Heterodera glycines
  Homolog annotation: Hit_ID=CAE60419.1; Match level="QueryCoverage =92%, HitCoverage=13%, E-value=7e-20, Identity=46%"; Hit description =Hypothetical protein CBG04025 [Caenorhabditis briggsae]
  Coding regions on vcDNA: vcDNA=SeqID_97133; Strand=-; Position=105-545
WLNSNSIPISGISSSPAQCSINGKSYGKALRMEYRMLSDEQRDRFHSALLKLKHLYNGCSEYDRFAFLHSGIDKMPSAHGGPTFPLWHREYLKRLEFGLRSIDPSVALPYSESY

SEQ ID NO: 170711 - protein, 131 aa, Heterodera glycines
  Homolog annotation: Hit_ID=CAE73459.1; Match level="QueryCoverage =99%, HitCoverage=39%, E-value=7e-28, Identity=40%"; Hit description =Hypothetical protein CBG20909 [Caenorhabditis briggsae]
  Gene Ontology: Mol. function=ligand-dependent nuclear receptor interactor activity; Cellular component=cytoplasm; Biological process=dauer larval development (sensu Nematoda)
  Coding regions on vcDNA: vcDNA=SeqID_97134; Strand=+; Position=2-394
PKNEFKALDAFALSAHLRPGRHRCDCQARLHSLVRNCIGCGRIVCAQEGSGRCFYCGRLVCTREEKTIIERKDGEGLRLLRCLLNDLQADYFSLEHNPYLTAAEREAIGNRKEELRQLSLSVKRNILVDLD

SEQ ID NO: 170712 - protein, 254 aa, Heterodera glycines
  Coding regions on vcDNA: vcDNA=SeqID_97135; Strand=+; Position=1-762
SGSPGLQEFGTRLITNSQNSPAYCVLAYDHGDGVLREIIDHLGLLESGGLGAQQKKIGSETLPCHTLHLDTKYYTCDVPLLSCHSFVRLKSICAAERRSNLSVFAVLFCVTRQQLTEDFLALVSQYSASLEKAEVKALVLRDDQTEEATTSMNTNDEVLNKFALSRRIEIIKIGRKTTNVVDDDEEEGLVGIPRIVESIETVCWPNMKLKPNPVKFFEHPTPLEKYINSEACADDTAVFDMFPGCADDFAPGIA

SEQ ID NO: 170713 - protein, 128 aa, Heterodera glycines
  Coding regions on vcDNA: vcDNA=SeqID_97136; Strand=-; Position=3-386
MLEEPATVRQRDADPEMDIPPNKENWARAFRSPIRHDGDVTGISWSPDSQMLASVSMDDSVAVHRADNGSSNGYFGRNERHKTSLLPPNRISINSPSSGRQFRNSFLWVYCYCFILQLYKVFHDDQLF

SEQ ID NO: 170714 - protein, 32 aa, Heterodera glycines; identical to SEQ ID NO: 168047
  Coding regions on vcDNA: vcDNA=SeqID_97137; Strand=+; Position=3-101

SEQ ID NO: 170715 - protein, 92 aa, Heterodera glycines
  Homolog annotation: Hit_ID=CAE62896.1; Match level="QueryCoverage =83%, HitCoverage=7%, E-value=1e-23, Identity=67%"; Hit description =Hypothetical protein CBG07084 [Caenorhabditis briggsae]
  Coding regions on vcDNA: vcDNA=SeqID_97138; Strand=+; Position=1-279
PSLIMLGIFVATFFSSMSNLIGASRVLTRFAQDKLFGALLRPATIEVGSKRNPIISVIISWICVVMVLMIGAMNRIAKLSFPTNTGIISGKM

SEQ ID NO: 170716 - protein, 64 aa, Heterodera glycines; identical to SEQ ID NO: 164073
  Coding regions on vcDNA: vcDNA=SeqID_97139; Strand=+; Position=2-196

SEQ ID NO: 170717 - protein, 97 aa, Heterodera glycines
  Coding regions on vcDNA: vcDNA=SeqID_97140; Strand=-; Position=66-359
MNIFWQAPSDGEVQCCNEFNVSNSTHICFRYLAPPQLAQGGKRKQRINSVGPAGQKTIGQWQRRSPYSLNFPTLTRSLASGRTQKARSSNNFKQYTI

SEQ ID NO: 170718 - protein, 56 aa, Heterodera glycines
  Homolog annotation: Hit_ID=XP_392164.1; Match level="QueryCoverage =83%, HitCoverage=12%, E-value=3e-13, Identity=65%"; Hit description =similar to endoA-PA [Apis mellifera]
  Gene Ontology: Mol. function=protein binding; Cellular component =cytoplasm; Biological process=signal transduction
  Coding regions on vcDNA: vcDNA=SeqID_97141; Strand=+; Position=2-172
LNPGELDFKEGQIIQLDSQIDEHWFEGTVDGRTGFFPITYVEVIVPIPSSSTTAQQ

SEQ ID NO: 170719 - protein, 69 aa, Heterodera glycines
  Coding regions on vcDNA: vcDNA=SeqID_97142; Strand=-; Position=13-222
LIYRFVSFRSSTTVISIAATSVFSLSASRSLPFPDGYASMINAQKAKESNKIIENFIFKEDLLFLIGYN

SEQ ID NO: 170720 - protein, 141 aa, Heterodera glycines
  Homolog annotation: Hit_ID=NP_741744.1; Match level="QueryCoverage =99%, HitCoverage=35%, E-value=1e-31, Identity=47%"; Hit description =o-fucosyltransferase 1 precursor (XD785) [Caenorhabditis elegans] sp|Q18014|OFU1_CAEEL Putative GDP-fucos
  Gene Ontology: Mol. function=fucosyltransferase activity; Cellular component=integral to Golgi membrane; Biological process=O-linked glycosylation
  Coding regions on vcDNA: vcDNA=SeqID_97143; Strand=+; Position=119-541
GCHATEGNPFGPFWRYAGTHFVGEEYFGVKTGGFDTQRETIREKWATEFPAHSSPVLAFSSAPAAFPVRPDHRFIQRFVQWNDRIKQKAIEFASRNFGHGKAFVGIHLRNGRDWENVCQFLREENVMGKRQLFASGQCTGP

SEQ ID NO: 170721 - protein, 42 aa, Heterodera glycines
  misc_feature (19)..(19): Xaa can be any naturally occurring amino acid
  Homolog annotation: Hit_ID=NP_641085.1; Match level="QueryCoverage =76%, HitCoverage=12%, E-value=4e-09, Identity=75%"; Hit description =hypothetical protein XAC0732 [Xanthomonas axonopodis pv. citri str. 306] gb|AAM35621.1| hypothetical prot
  Coding regions on vcDNA: vcDNA=SeqID_97144; Strand=+; Position=201-329
AESWNCGRPPPPPPPPPPXARGAPPLPPPPYPPPPHPPFQIN

SEQ ID NO: 170722 - protein, 125 aa, Heterodera glycines
  Homolog annotation: Hit_ID=CAG59394.1; Match level="QueryCoverage =88%, HitCoverage=58%, E-value=1e-11, Identity=39%"; Hit description =unnamed protein product [Candida glabrata CBS138] ref|XP_446467.1| unnamed protein product [Candida glabra
  Gene Ontology: Mol. function=chaperone activity; Cellular component =nucleolus; Biological process=nucleocytoplasmic transport
  Coding regions on vcDNA: vcDNA=SeqID_97145; Strand=+; Position=9-383
MKLFSMFLLLTLAFAAFAESSSSSSSESSESSEECSSEEGNPGTEPETTTVVDSDENCNATSDSPNDESSPVPSSDSPNDESSPVPSSDSPNDESSPVPSSDSPNDESSPVPSSDSPNDDSSSVP

SEQ ID NO: 170723 - protein, 128 aa, Heterodera glycines
  Homolog annotation: Hit_ID=CAG59394.1; Match level="QueryCoverage =90%, HitCoverage=56%, E-value=1e-11, Identity=39%"; Hit description =unnamed protein product [Candida glabrata CBS138] ref|XP_446467.1| unnamed protein product [Candida glabra
  Gene Ontology: Mol. function=chaperone activity; Cellular component =nucleolus; Biological process=nucleocytoplasmic transport
  Coding regions on vcDNA: vcDNA=SeqID_97146; Strand=+; Position=16-399
MKLFSMFLLLTLAFAAFAESSSSSSSESSESSEECSSEEGNPGTEPETTTVVDSDENCNATSDSPNDESSPVPSSDSPNDESSPVPSSDSPNDESSPVPSSDSPNDESSPVPSSDSPNDESSPVPSSD

SEQ ID NO: 170724 - protein, 70 aa, Heterodera glycines; identical to SEQ ID NO: 164106
  Coding regions on vcDNA: vcDNA=SeqID_97147; Strand=+; Position=232-441

SEQ ID NO: 170725 - protein, 62 aa, Heterodera glycines
  misc_feature (1)..(1): Xaa can be any naturally occurring amino acid
  Coding regions on vcDNA: vcDNA=SeqID_97148; Strand=-; Position=88-276
XVINEYNQELIRSPKKIHFLLLSGNLVGELSNVPCPHPTGQSFPTFVRLLLICISIYRRKVR

SEQ ID NO: 170726 - protein, 34 aa, Heterodera glycines
  Coding regions on vcDNA: vcDNA=SeqID_97149; Strand=-; Position=59-163
YFFFFFFFFFFFFFEHKKFITGKYLQNEKALKLY

SEQ ID NO: 170727 - protein, 112 aa, Heterodera glycines; identical to SEQ ID NO: 154158
  Homolog annotation: Hit_ID=AAH77445.1; Match level="QueryCoverage =66%, HitCoverage=12%, E-value=4e-15, Identity=49%"; Hit description =LOC398357 protein [Xenopus laevis]
  Gene Ontology: Mol. function=ATP dependent DNA helicase activity; Cellular component=nucleus; Biological process=DNA ligation
  Coding regions on vcDNA: vcDNA=SeqID_97150; Strand=+; Position=3-341

SEQ ID NO: 170728 - protein, 25 aa, Heterodera glycines
  Coding regions on vcDNA: vcDNA=SeqID_97151; Strand=+; Position=1-78
GSMFTEGISEGVIIRKIFINELKIN

SEQ ID NO: 170729 - protein, 180 aa, Heterodera glycines
  Coding regions on vcDNA: vcDNA=SeqID_97152; Strand=+; Position=2-541
FNTFWIGLRRVLVGNRYQSTWTNGSAAIFGNVPEITTAASRNTSPWAAGQPSGTNKYTDPTGAKEECVHMLNAEGRWNDARCEIQMTGAICKKAAQSVGSSGTVVSSAVVFPSSAFDLCNPSVSQCNGFGWTISSGKCYKVIEGLMNGTQAVVACTAEDPQAQLVSIWDEGENRLISQII

SEQ ID NO: 170730 - protein, 121 aa, Heterodera glycines
  Coding regions on vcDNA: vcDNA=SeqID_97153; Strand=-; Position=18-383
RSFSYHFSLLFLPISLFFLHHLFQSFCFALIDPLLKLHSQILAHSFCEPGSVAQFLKHLSLVQLRRLIRLCSFIRPLTSEGKALTTAIWEGCSNERSTERRSRTAKKSFVNISKLKITGRV

SEQ ID NO: 170731 - protein, 60 aa, Heterodera glycines
  Homolog annotation: Hit_ID=NP_498620.1; Match level="QueryCoverage =93%, HitCoverage=24%, E-value=5e-20, Identity=71%"; Hit description=- related (24.4 kD) (3I436) [Caenorhabditis elegans] gb|AAK68310.1| Hypothetical protein F08F8.7 [Caenorha
  Gene Ontology: Mol. function=ribulose-phosphate 3-epimerase activity; Cellular component=cytosol; Biological process=pentose-phosphate shunt
  Coding regions on vcDNA: vcDNA=SeqID_97154; Strand=+; Position=23-389
MASKIKPLICPSILNTDLSDLADECRRLMAAGADYLHLDIMDGHFVPNLTFGHPLIECLR

SEQ ID NO: 170732 - protein, 131 aa, Heterodera glycines
  Coding regions on vcDNA: vcDNA=SeqID_97155; Strand=+; Position=1-396
YVELDELNKNGADGTRAKLEYSMRDAFGGLDAQTLDAHIQKAKRNGTVFDALIRHNHVMYEANNNWRLNATQRAVHLCALEFVDYKMFEQCLANDANTNDQIPAAIPLAIGGFAVPFLVTLSSILTLLLPF

SEQ ID NO: 170733 - protein, 88 aa, Heterodera glycines
  Coding regions on vcDNA: vcDNA=SeqID_97156; Strand=+; Position=2-268
KMKLHSATLSKRLFLAGGPSPFSSSFCSFCCRIRFRPVHSFPPLSESAVSCPPSSAFFCCFSAAVLFFSSSKMVSTASGNLKSEKQLD

SEQ ID NO: 170734 - protein, 78 aa, Heterodera glycines; identical to SEQ ID NO: 164096
  Homolog annotation: Hit_ID=NP_505873.1; Match level="QueryCoverage =70%, HitCoverage=8%, E-value=1e-09, Identity=58%"; Hit description =sodium:neurotransmitter symporter family member (snf-11) [Caenorhabditis elegans] emb|CAA98519.1| Hypothet
  Coding regions on vcDNA: vcDNA=SeqID_97157; Strand=+; Position=242-478

SEQ ID NO: 170735 - protein, 148 aa, Heterodera glycines
  Homolog annotation: Hit_ID=CAE63460.1; Match level="QueryCoverage =65%, HitCoverage=84%, E-value=2e-19, Identity=51%"; Hit description =Hypothetical protein CBG07924 [Caenorhabditis briggsae]
  Coding regions on vcDNA: vcDNA=SeqID_97158; Strand=+; Position=36-482
MSFQQIFSTSAVLFGLVFITSTLSAPAPKPQNQQQHPAEKQPFNAYLNPGFDKRSFDSFTGPGFTGLDKRAAFDTGFTNYDKRAFDSFTGPGFTGLDKRFEPFDGYGFNGFEKRSFDSFMGPGFTGMDKKKRAFDSFTGPGFTGMDRK

SEQ ID NO: 170736 - protein, 119 aa, Heterodera glycines
  Homolog annotation: Hit_ID=XP_394559.1; Match level="QueryCoverage =99%, HitCoverage=64%, E-value=7e-38, Identity=60%"; Hit description =similar to ADP-ribosylation factor-like 2 [Apis mellifera]
  Gene Ontology: Mol. function=ATP binding; Cellular component =microtubule cytoskeleton; Biological process=small GTPase mediated signal transduction
  Coding regions on vcDNA: vcDNA=SeqID_97159; Strand=+; Position=42-398
GFNIETLEFMGWKLNCWDVGGQKSLRTYWRNYFERTDAVIWVVDACDVCRLDDCFNELHSLINEECLHGVTLLVLANKRDLPGSINAHEIEKILRLEKIKHHWRVYEASAYTGHGLLES

SEQ ID NO: 170737 - protein, 50 aa, Heterodera glycines
  Coding regions on vcDNA: vcDNA=SeqID_97160; Strand=+; Position=2-154
VCLDRCVSKYLEVHDRLGKLLTQMTQQDDRAVQQQQQNLAAAAQKMHINK

SEQ ID NO: 170738 - protein, 132 aa, Heterodera glycines
  Homolog annotation: Hit_ID=CAE63438.1; Match level="QueryCoverage =97%, HitCoverage=18%, E-value=1e-48, Identity=70%"; Hit description =Hypothetical protein CBG07886 [Caenorhabditis briggsae]
  Gene Ontology: Mol. function=carnitine O-palmitoyltransferase activity; Cellular component=mitochondrion; Biological process=fatty acid beta-oxidation
  Coding regions on vcDNA: vcDNA=SeqID_97161; Strand=+; Position=1-396
LQLTYFRNQGSFSLTYEASITRLFREGRTETIRSCTNESCDFVRAMLDPQQKNEERLRLLRLAAERHQNLTRDAMCGKGVDRHLFALYVVMRHLEESSPFFDKIFPPQYLLSTSQTPLNQFDSEQEGISMAQ

SEQ ID NO: 170739 - protein, 135 aa, Heterodera glycines
  Homolog annotation: Hit_ID=AAF74348.1; Match level="QueryCoverage =65%, HitCoverage=18%, E-value=3e-15, Identity=46%"; Hit description =putative sugar permease [Lactobacillus casei]
  Coding regions on vcDNA: vcDNA=SeqID_97162; Strand=+; Position=14-418
MSSGTVSPLRDVPLRLSDKPSLPFPSPRRLTNDCPSSPSPAPITLYLRLVSWVCSMGGLLFGYASSSINDLLPFIVREMRLGPAEVGVVISCFMVGAGIGGFVGGRLADRIGRKRSLVLFDALFIVFSVCTSLAP

SEQ ID NO: 170740 - protein, 117 aa, Heterodera glycines
  Homolog annotation: Hit_ID=NP_496370.1; Match level="QueryCoverage =99%, HitCoverage=45%, E-value=4e-20, Identity=42%"; Hit description =phosphatase 2C (2L343) [Caenorhabditis elegans] emb|CAB04260.1| Hypothetical protein F33A8.6 [Caenorhabdi
  Coding regions on vcDNA: vcDNA=SeqID_97163; Strand=+; Position=2-393
LYALFDGHAGRRAADYCAEHFARLFVAVFKKYVPPKSAMSVFEKSIRKVFVDTYKGIDDGFLVEARRQKPTLKDGTTATTIFLLDKTLYCASIGDSKAIVCRHKSEKSTNIPLQITV

SEQ ID NO: 170741 - protein, 41 aa, Heterodera glycines
  Homolog annotation: Hit_ID=ZP_00357698.1; Match level="QueryCoverage =80%, HitCoverage=16%, E-value=4e-10, Identity=83%"; Hit description =hypothetical protein Chlo02002738 [Chloroflexus aurantiacus]
  Coding regions on vcDNA: vcDNA=SeqID_97164; Strand=-; Position=93-218
FFFFFFFFFFFLFFFFFFFFFFFFFFCSDFYNSTIIKHKKE

SEQ ID NO: 170742 - protein, 121 aa, Heterodera glycines
  Homolog annotation: Hit_ID=Q05859; Match level="QueryCoverage=74%, HitCoverage=9%, E-value=2e-11, Identity=39%"; Hit description=Formin 1 isoform IV (Limb deformity protein) pir||S24407 formin isoform IV - mouse emb|CAA44244.1| formin, isof
  Gene Ontology: Mol. function=RNA binding; Cellular component=nucleus; Biological process=mRNA processing
  Coding regions on vcDNA: vcDNA=SeqID_97165; Strand=-; Position=27-392
PRLPPGVPRPRPLPKPPRLAIPPRPPGGPLPPRPPRINDPPRTCGAPADLKPPEELPFIGPPASSPLPSAPFESPPPSLSPPPSNAFKFGLGSVVMPSMCVSLTLIGCSSSARTARTPATR

SEQ ID NO: 170743 - protein, 52 aa, Heterodera glycines; identical to SEQ ID NO: 164199
  Coding regions on vcDNA: vcDNA=SeqID_97166; Strand=+; Position=21-179

SEQ ID NO: 170744 - protein, 38 aa, Heterodera glycines
  Coding regions on vcDNA: vcDNA=SeqID_97167; Strand=+; Position=1-114
IALRSVIPEKGRCNETDHFRLDGKMWTRLSTTESANWK

SEQ ID NO: 170745 - protein, 42 aa, Heterodera glycines
  Coding regions on vcDNA: vcDNA=SeqID_97168; Strand=+; Position=2-130
GAWLSVQQLLTHLFFFDQHLSKYSNLMALFHLIIFIFSYCNW

SEQ ID NO: 170746 - protein, 121 aa, Heterodera glycines
  Homolog annotation: Hit_ID=AAP30764.1; Match level="QueryCoverage =89%, HitCoverage=25%, E-value=3e-36, Identity=69%"; Hit description =putative gland protein G28B03 [Heterodera glycines]
  Coding regions on vcDNA: vcDNA=SeqID_97169; Strand=+; Position=1-363
IQTHQIHSTSSPTVNIMLRIALLISILALFGDCMDKGKRKLGGISINEPSEYRTKEKEAIATSRKGKEKVGEKISVMNTAERIEKMDIAQGKAKMDIDTNVKPKQNEESAPPKYVFIWSGN

SEQ ID NO: 170747 - protein, 111 aa, Heterodera glycines
  Homolog annotation: Hit_ID=NP_499816.1; Match level="QueryCoverage =97%, HitCoverage=27%, E-value=4e-10, Identity=33%"; Hit description =ARRestin and ARRestin family member (3O716) [Caenorhabditis elegans] pir||T24860 hypothetical protein T12
  Coding regions on vcDNA: vcDNA=SeqID_97170; Strand=+; Position=200-532
YLIRSFHRSKTFAGAEQRRTTKNVVERVRLKKVPSGSEFESGALPLAVPSVPPRLAPKCRLIDISYSVELSCQSPPFCVSLPVVIGTIPLLPPNLRSNDQNVAQNNGTNGV

SEQ ID NO: 170748 - protein, 115 aa, Heterodera glycines
  misc_feature (56)..(56): Xaa can be any naturally occurring amino acid
  Homolog annotation: Hit_ID=AAN32890.1; Match level="QueryCoverage =100%, HitCoverage=100%, E-value=3e-48, Identity=66%"; Hit description=secretory protein 4D09 [Heterodera glycines]
  Coding regions on vcDNA: vcDNA=SeqID_97171; Strand=+; Position=18-364
MAKFVAIALLSLTIVSMAPAKTGKSQTADEVEGFRNMNIGDNNKVDAGKEPAAAKXNDQLMGMSVEKFNEELAVLLPKANTFMENALSFINEQMEKNGIATGAAGDSCSTGIPAN

SEQ ID NO: 170749 - protein, 72 aa, Heterodera glycines
  Coding regions on vcDNA: vcDNA=SeqID_97172; Strand=+; Position=11-229
MLRGKWPNNWSPKFCVGKALEGSTVGIFGMGRIGRSIADKLSAFRPFEIIYHNRKANSEYGRIDGRLNDFAN

SEQ ID NO: 170750 - protein, 67 aa, Heterodera glycines
  misc_feature (23)..(23): Xaa can be any naturally occurring amino acid
  Coding regions on vcDNA: vcDNA=SeqID_97173; Strand=-; Position=149-352
LLRFPRQKVRLMAMIMQKENTNXRTTDRPKTKQNNRRILCFPFNSNLVQQNLNGYRWKGKRKIKILP

SEQ ID NO: 170751 - protein, 83 aa, Heterodera glycines
  Coding regions on vcDNA: vcDNA=SeqID_97174; Strand=-; Position=19-270
ILYFRKTQKISNAFVLSKKQSPNFSSTFIYSKSFFTHVRSCSATPAAGACLGLLGLVGEMSVHHLFLFIQSIKYLQKGISLLL

SEQ ID NO: 170752 - protein, 79 aa, Heterodera glycines; identical to SEQ ID NO: 164133
  Homolog annotation: Hit_ID=EAA62187.1; Match level="QueryCoverage =54%, HitCoverage=21%, E-value=2e-14, Identity=86%"; Hit description =predicted protein [Aspergillus nidulans FGSC A4] ref|XP_409382.1| predicted protein [Aspergillus nidulans
  Coding regions on vcDNA: vcDNA=SeqID_97175; Strand=-; Position=54-293

SEQ ID NO: 170753 - protein, 79 aa, Heterodera glycines
  Homolog annotation: Hit_ID=CAE57999.1; Match level="QueryCoverage =100%, HitCoverage=28%, E-value=6e-21, Identity=56%"; Hit description= Hypothetical protein CBG01062 [Caenorhabditis briggsae]
  Coding regions on vcDNA: vcDNA=SeqID_97176; Strand=+; Position=3-239
LDQVNGLPDMVFACNSGLFYRNKLYLSHFRHAQRIGEQRHFADFYKGLGLELYGADCAEVFEGGGDAFFSDERTLWAGW

SEQ ID NO: 170754 - protein, 86 aa, Heterodera glycines; identical to SEQ ID NO: 164069
  Homolog annotation: Hit_ID=AAB07482.1; Match level="QueryCoverage =93%, HitCoverage=17%, E-value=1e-31, Identity=80%"; Hit description =beta-II tubulin sp|Q94571|TBB2_HOMAM TUBULIN BETA-2 CHAIN (BETA-II TUBULIN)
  Gene Ontology: Mol. function=GTP binding; Cellular component=tubulin; Biological process=microtubule-based process
  Coding regions on vcDNA: vcDNA=SeqID_97177; Strand=+; Position=2-262

SEQ ID NO: 170755 - protein, 72 aa, Heterodera glycines; identical to SEQ ID NO: 167942
  Homolog annotation: Hit_ID=AAM44291.1; Match level="QueryCoverage =61%, HitCoverage=28%, E-value=2e-13, Identity=75%"; Hit description =superoxide dismutase [Aplysia californica]
  Gene Ontology: Mol. function=copper, zinc superoxide dismutase activity; Cellular component=cytoplasm; Biological process =neurogenesis
  Coding regions on vcDNA: vcDNA=SeqID_97178; Strand=+; Position=98-316

SEQ ID NO: 170756 - protein, 160 aa, Heterodera glycines
  Homolog annotation: Hit_ID=NP_506599.1; Match level="QueryCoverage =98%, HitCoverage=34%, E-value=6e-78, Identity=82%"; Hit description =histone deacetylase, abnormal GONad development GON-10 (52.1 kD) (hda-1) [Caenorhabditis elegans] emb|CAB
  Gene Ontology: Mol. function=transcription factor binding; Cellular component=cytoplasm; Biological process=chromatin silencing
  Coding regions on vcDNA: vcDNA=SeqID_97179; Strand=+; Position=7-486
MPNSGVQNHYRKRVAYYYDSNVGNYYYGQGHVMKPHRIRMTHHLLLNYGVYRHLDVYRPFPASLEDMTRFHSEEYMDFLRSATPETLKQFNKQMLKFNVGEDCPVFDGLFEFCQLSSGGSLAAAVKLNKQKAEIAINWMGGLHHAKKSEASGFCYTNDIV

SEQ ID NO: 170757 - protein, 126 aa, Heterodera glycines
  Homolog annotation: Hit_ID=AAP30835.1; Match level="QueryCoverage =99%, HitCoverage=100%, E-value=1e-39, Identity=70%"; Hit description= putative gland protein G33E05; Hg-G33E05 [Heterodera glycines]
  Coding regions on vcDNA: vcDNA=SeqID_97180; Strand=+; Position=49-426
MRTFLFIAVVGLVLAVIMESVNATGNNSPTKGQTPPGSPKGGHGSNKSPTTPHSAGSPHGTQHGNQQNHATGQSPPDSTKRETELIIEKVSNVVQNVDNKPRSAAASHLVPPTPGNSPTAHDSRHT

SEQ ID NO: 170758 - protein, 89 aa, Heterodera glycines; identical to SEQ ID NO: 148232
  Coding regions on vcDNA: vcDNA=SeqID_97181; Strand=+; Position=1-270

SEQ ID NO: 170759 - protein, 86 aa, Heterodera glycines
  Coding regions on vcDNA: vcDNA=SeqID_97182; Strand=+; Position=1-258
LIKINNRLFLPSPGGDRGEWMMECDRLLRINAVDASEKEAAFAGKRLTRLIRPRMDQRRRLFRCSGVVASASGVVSSSLRFTMRVG

SEQ ID NO: 170760 - protein, 66 aa, Heterodera glycines
  Coding regions on vcDNA: vcDNA=SeqID_97183; Strand=+; Position=58-258
FTKKLINDFFVLEALREREEEQIRLLESERDNFILFQTFYFDFTLLNFNSTAFNSRLNFKLNIYNK

SEQ ID NO: 170761 - protein, 97 aa, Heterodera glycines
  Homolog annotation: Hit_ID=CAC84452.1; Match level="QueryCoverage =58%, HitCoverage=16%, E-value=1e-17, Identity=67%"; Hit description =polyglutamate synthase [Meloidogyne artiellia]
  Coding regions on vcDNA: vcDNA=SeqID_97184; Strand=+; Position=1-294
SAEEIARKIGKVRAKRGWRRSHLPNKAQSQKTHFNNQNRRPSGDVVVLSLHWGGNWGYEISKTERDFAHQLIDSGTVDILYGHSSHHPKAIEVISRQ

SEQ ID NO: 170762 - protein, 50 aa, Heterodera glycines
  Homolog annotation: Hit_ID=ZP_00357698.1; Match level="QueryCoverage =68%, HitCoverage=20%, E-value=1e-10, Identity=92%"; Hit description =hypothetical protein Chlo02002738 [Chloroflexus aurantiacus]
  Coding regions on vcDNA: vcDNA=SeqID_97185; Strand=-; Position=5-154
FFFFFFFFFFFFFFFFFFFFFFFFFFDFSLLVTLRWETIEWIFNHFHHLS

SEQ ID NO: 170763 - protein, 83 aa, Heterodera glycines; identical to SEQ ID NO: 164236
  Coding regions on vcDNA: vcDNA=SeqID_97186; Strand=+; Position=44-295

SEQ ID NO: 170764 - protein, 71 aa, Heterodera glycines
  Coding regions on vcDNA: vcDNA=SeqID_97187; Strand=+; Position=189-404
FGNKSCFCFCRIGGDEDVVLAVRNALIAGETMFDSNIALLVQNAVQNVHFQKPPADDNADGGAEQMPMETT

SEQ ID NO: 170765 - protein, 146 aa, Heterodera glycines
  Homolog annotation: Hit_ID=NP_497949.1; Match level="QueryCoverage =99%, HitCoverage=40%, E-value=6e-48, Identity=58%"; Hit description =protein phosphatase 2C, possibly N-myristoylated (39.1 kD) (3F743) [Caenorhabditis elegans] emb|CAA86456.
  Gene Ontology: Mol. function=protein phosphatase type 2C activity; Biological process=cell cycle
  Coding regions on vcDNA: vcDNA=SeqID_97188; Strand=+; Position=13-450
MGQALSEPITTKNSASCSNDRYFVGSSSMQGWRISMEDAHTHLLELPEDPSTAFFAVFDGHGGAQIAKYASENLHTQIAQSNTFREGRISDALVEAFLELDEQMMASEQIREEMSGSTAVAVLIKDNFIYCANAGDSRAVASVDGR

SEQ ID NO: 170766 - protein, 150 aa, Heterodera glycines
  Homolog annotation: Hit_ID=NP_498534.1; Match level="QueryCoverage =98%, HitCoverage=33%, E-value=2e-26, Identity=42%"; Hit description =UBiquitin Activating enzme related, ectopic membrane RuFfLes in embryo RFL-1, CYtoKinesis defect CYK-5 (r
  Gene Ontology: Biological process=endomitotic cell cycle
  Coding regions on vcDNA: vcDNA=SeqID_97189; Strand=+; Position=1-453
PAVASTNAIIAGSCALEALKLASNISCSLNNYLNFANVEGICFNVVALERDPECLVCGQKSVQMYSVREDCTLSGFLDDLKDKYPLQNPSIRAGSTFLYEINTLMPEMETASRKNLCKTLKELHVTEDSELLVADEALTRSIVFRIEYSK

SEQ ID NO: 170767 - protein, 87 aa, Heterodera glycines
  Coding regions on vcDNA: vcDNA=SeqID_97190; Strand=+; Position=34-297
FLADLKPSIACRFSAQQSTNTVFDSLQKNNSLPKSFLQPLIANIISCRFKAIHCLPVSAQQSTNRVFDSLQKIIPYPKVFYNHILPI

SEQ ID NO: 170768 - protein, 67 aa, Heterodera glycines
  Coding regions on vcDNA: vcDNA=SeqID_97191; Strand=+; Position=192-392
RNQNANELAKNGVKQSNVSVRTQKSAYMSGQDYSLNLVYQQFLFEEAQRFQGHFPTPCHFPQCNRKP

SEQ ID NO: 170769 - protein, 73 aa, Heterodera glycines
  Coding regions on vcDNA: vcDNA=SeqID_97192; Strand=+; Position=18-239
MEKNTESLSKLDPSETLGTDALLQLKELREKGKLESYGRITDEKGEEKDSWGHALQKELDEKVRKFRELNRKK

SEQ ID NO: 170770 - protein, 221 aa, Heterodera glycines
  Homolog annotation: Hit_ID=AAC48326.1; Match level="QueryCoverage =99%, HitCoverage=68%, E-value=1e-123, Identity=98%"; Hit description= beta-1,4-endoglucanase-2 precursor [Heterodera glycines]
  Coding regions on vcDNA: vcDNA=SeqID_97193; Strand=+; Position=64-726
MFVQLVLLAIVGITFVDAAAPPFGQLYVKGTNLVGSNGKPVQLIGNSLFWHQWYPQFWNAQTVKALKCNWNSNVVRTAMGVEQGGYLSDANTAYRLTAAVIEAAIAQGIYVIVDWHAHEPNADKAIEFFTKIAKAYGSNPHLLYETFNEPLDVSWNDVLVPYHKKVISAIRAIDKKNVIILGTPKWSQDVDVAAQNPDQGFSNLMYTLHFYASSHFGDGLA

SEQ ID NO: 170771 - protein, 39 aa, Heterodera glycines; identical to SEQ ID NO: 167973
  Coding regions on vcDNA: vcDNA=SeqID_97194; Strand=+; Position=3-122

SEQ ID NO: 170772 - protein, 67 aa, Heterodera glycines
  Coding regions on vcDNA: vcDNA=SeqID_97195; Strand=+; Position=146-349
MDCCHIINCQPYKSHFFKEEMDRDDDKTVERAVRESPIVVSESSATDGKIFKSFKFLKIFKNYTKNV

SEQ ID NO: 170773 - protein, 35 aa, Heterodera glycines
  Coding regions on vcDNA: vcDNA=SeqID_97196; Strand=-; Position=4-111
NESLIIQNINYHLDFFLSKIQHRRFVFPNEESECV

SEQ ID NO: 170774 - protein, 70 aa, Heterodera glycines
  Coding regions on vcDNA: vcDNA=SeqID_97197; Strand=+; Position=38-250
GKLVRLPVPVRNSRVDIIIIMAANTTHYRARRLMRTTGRGSLRPAVFKRLLSPALAHSNRRDEGDERRHN

SEQ ID NO: 170775 - protein, 85 aa, Heterodera glycines
  Homolog annotation: Hit_ID=AAA73456.2; Match level="QueryCoverage =100%, HitCoverage=75%, E-value=6e-40, Identity=91%"; Hit description= beta-galactosidase alpha peptide [Cloning vector pSport1]
  Coding regions on vcDNA: vcDNA=SeqID_97198; Strand=+; Position=1-540
TMITPSSNTSHYRESWYACPYRSGIPGTLRLVVGGRSRGSKLTYACMRRHSSSIVSPKFNSLAVVLQRRDWENPGVTQLNRLAAH

SEQ ID NO: 170776 - protein, 100 aa, Heterodera glycines
  Homolog annotation: Hit_ID=CAE63854.1; Match level="QueryCoverage =93%, HitCoverage=54%, E-value=9e-25, Identity=56%"; Hit description =Hypothetical protein CBG08414 [Caenorhabditis briggsae]
  Coding regions on vcDNA: vcDNA=SeqID_97199; Strand=+; Position=1-303
VFAIAFHNFPNVAQEGAKEFVFWHWAQLQFKNPHVQFVKLADVCVTPFVQAFLCDGREVVFDLECRTREQISEALIGTLGMTETVRKRMKMDSYKREKRV

SEQ ID NO: 170777 - protein, 120 aa, Heterodera glycines
  Homolog annotation: Hit_ID=AAA20541.1; Match level="QueryCoverage =97%, HitCoverage=90%, E-value=6e-59, Identity=62%"; Hit description =beta-galactoside-binding lectin
  Gene Ontology: Mol. function=lectin; Cellular component=plasma membrane; Biological process=cell adhesion
  Coding regions on vcDNA: vcDNA=SeqID_97200; Strand=+; Position=61-420
MAAESQYPIPYRSKLTEPFEPGQTLIVKGKTAEDSVRFTINLHHTSADFSGNDVPLHISVRFDEGKIVFNTFSKGEWGKEERKSNPYKKGDDIDLRIRAHDSKFTVYADQKELKEFEHRV

SEQ ID NO: 170778 - protein, 113 aa, Heterodera glycines
  Coding regions on vcDNA: vcDNA=SeqID_97201; Strand=-; Position=73-414
KKYKNLFLFLKFNILNAAKNKRLKALCARSFLSSILCFFFLAMASNHHLRRCCHFLLRVSLFLLPYLLFCCFLFLLPFLHFRFSFFHLLFLHFRFFVVSFKIFTISRWICIDD

SEQ ID NO: 170779 - protein, 83 aa, Heterodera glycines; identical to SEQ ID NO: 164160
  Coding regions on vcDNA: vcDNA=SeqID_97202; Strand=+; Position=134-382

SEQ ID NO: 170780 - protein, 44 aa, Heterodera glycines
  Coding regions on vcDNA: vcDNA=SeqID_97203; Strand=-; Position=142-276
MRWYLWYNEKNAFKRITNAGKIRSNQIRTVNNINLTPILGIISC

SEQ ID NO: 170781 - protein, 67 aa, Heterodera glycines
  Coding regions on vcDNA: vcDNA=SeqID_97204; Strand=-; Position=196-399
MVPNKHAENLKPVKPFQALFSFVRPIVRKQLQNLRIANSRCGFFCTHSDDRPHKRSVSLFLVTTSSR

SEQ ID NO: 170782 - protein, 33 aa, Heterodera glycines
  Coding regions on vcDNA: vcDNA=SeqID_97205; Strand=-; Position=59-160
FFFFFFFSFVLFIFSRKSCQKFSKQLNFSHRVK

SEQ ID NO: 170783 - protein, 57 aa, Heterodera glycines
  misc_feature (48)..(48): Xaa can be any naturally occurring amino acid
  misc_feature (51)..(52): Xaa can be any naturally occurring amino acid
  Coding regions on vcDNA: vcDNA=SeqID_97206; Strand=+; Position=2-172
HPCPRGRSLRFLHPQPFFYSFCWTFRSIFFTILRIFNSSIASLINFVXGKXXKNFFF

SEQ ID NO: 170784 - protein, 135 aa, Heterodera glycines
  misc_feature (56)..(56): Xaa can be any naturally occurring amino acid
  misc_feature (74)..(74): Xaa can be any naturally occurring amino acid
  misc_feature (88)..(88): Xaa can be any naturally occurring amino acid
  misc_feature (106)..(106): Xaa can be any naturally occurring amino acid
  Homolog annotation: Hit_ID=AAL31950.1; Match level="QueryCoverage =89%, HitCoverage=27%, E-value=8e-23, Identity=55%"; Hit description =CDH1-D [Gallus gallus]
  Coding regions on vcDNA: vcDNA=SeqID_97207; Strand=+; Position=2-404
VDDSPLQGIPRSRTIIAMSDPNHGKSSPVYQPLSGKDKHADFASVARVKPRTSKGXHRPVIAQFRAAEHRKSLXEVVPTEAMSQLFSXARVSLVIGINQTNRSTNXERPCTTIHRIMKKLSICQSLRCPGRVSSW

SEQ ID NO: 170785 - protein, 100 aa, Heterodera glycines; identical to SEQ ID NO: 164253
  Homolog annotation: Hit_ID=CAE62276.1; Match level="QueryCoverage =99%, HitCoverage=10%, E-value=8e-40, Identity=80%"; Hit description =Hypothetical protein CBG06335 [Caenorhabditis briggsae]
  Gene Ontology: Mol. function=malate synthase activity; Cellular component=peroxisomal matrix; Biological process=glyoxylate cycle
  Coding regions on vcDNA: vcDNA=SeqID_97208; Strand=+; Position=1-303

SEQ ID NO: 170786 - protein, 50 aa, Heterodera glycines
  misc_feature (12)..(12): Xaa can be any naturally occurring amino acid
  Coding regions on vcDNA: vcDNA=SeqID_97209; Strand=-; Position=1-150
FFFFFFFFFFFXFIDFIQKYFCIIFSKKQMVVGGGEGDEKKRFSAVCAVV

SEQ ID NO: 170787 - protein, 50 aa, Heterodera glycines
  Coding regions on vcDNA: vcDNA=SeqID_97210; Strand=-; Position=0-149
SLVIRILLFLSLSTLSSSLSLPIISLYSLSPSHLPLLSLPLSSPSTFSLS

SEQ ID NO: 170788 - protein, 53 aa, Heterodera glycines
  Coding regions on vcDNA: vcDNA=SeqID_97211; Strand=+; Position=3-161
KPKRVNSVWPTPSWGQLRLANSVLGPTPSEPTPSRQLRLANSVLVPKGPTPSQ

SEQ ID NO: 170789 - protein, 133 aa, Heterodera glycines
  Homolog annotation: Hit_ID=XP_416078.1; Match level="QueryCoverage =99%, HitCoverage=9%, E-value=2e-23, Identity=42%"; Hit description =PREDICTED: similar to TIP120 protein [Gallus gallus]
  Coding regions on vcDNA: vcDNA=SeqID_97212; Strand=+; Position=1-399
QKYLPFLLKEISREEGRRQFLFLHALKEVINSECGECGTVGDADEIFKKGVEQIWELLMKYCDSAEESIRNVVAECIGRLIMVNPQKYVEELLRHSADSQANVRATVVTALRFIIVEQPRPVDDFLRPVIGKF

SEQ ID NO: 170790 - protein, 134 aa, Heterodera glycines
  Homolog annotation: Hit_ID=XP_317421.1; Match level="QueryCoverage =100%, HitCoverage=44%, E-value=5e-38, Identity=50%"; Hit description= ENSANGP00000011650 [Anopheles gambiae]
  Coding regions on vcDNA: vcDNA=SeqID_97213; Strand=+; Position=1-402
VVAQIILMLWKRRHFRSYQFATLVGLWLIPFMVSLKNGWWRFILSWTVFTSSIFYVWRRVNQPAISGSTPRLVYKYFLFMHKLSYIFGIVGYFSLVFTVIGINSVFGISSNLSLDFGVHLLFYGLYYGVLGRDL

SEQ ID NO: 170791 - protein, 91 aa, Heterodera glycines; identical to SEQ ID NO: 164198
  Coding regions on vcDNA: vcDNA=SeqID_97214; Strand=+; Position=13-288

SEQ ID NO: 170792 - protein, 79 aa, Heterodera glycines
  Coding regions on vcDNA: vcDNA=SeqID_97215; Strand=-; Position=89-328
GNLCHFQLLFRTNSNFLFLKVRTSSTAFVLSILCGTSIELCTPKKFFQYIGTYSKVTHVPFTINVVMLNDSHQMQRSAG

SEQ ID NO: 170793 - protein, 83 aa, Heterodera glycines
  Coding regions on vcDNA: vcDNA=SeqID_97216; Strand=-; Position=1-249
GRSEEDKCRGIRAFLLRCATVNQMAAVVHSDQCKANDTNHNDQSHIKIIPPIVGIVFPNFLRWQHLKWKYFVERIRNSRQITL

SEQ ID NO: 170794 - protein, 64 aa, Heterodera glycines
  Homolog annotation: Hit_ID=XP_395830.1; Match level="QueryCoverage =100%, HitCoverage=4%, E-value=3e-23, Identity=75%"; Hit description =similar to mKIAA1007 protein [Apis mellifera]
  Gene Ontology: Cellular component=CCR4-NOT core complex; Biological process=reproduction
  Coding regions on vcDNA: vcDNA=SeqID_97217; Strand=+; Position=1-405
SHTHYFSCTLLYLFLGANSKHIQEQITRILFERLVALRPHPWGLLITFIELIRNQRYGFWKHEF

SEQ ID NO: 170795 - protein, 132 aa, Heterodera glycines
  Homolog annotation: Hit_ID=CAE65868.1; Match level="QueryCoverage =89%, HitCoverage=20%, E-value=2e-15, Identity=40%"; Hit description =Hypothetical protein CBG11012 [Caenorhabditis briggsae]
  Coding regions on vcDNA: vcDNA=SeqID_97218; Strand=+; Position=2-397
LEVLSLDKCDLKELEEDIFENLTSLRALSLSGNPLDRIPAALSPLHSLTHLAMSSTNLKELKEGDFQKTVPGLEKLYMRKMKYLWKIGENTFNGLVNLKFIDFSTSAKLRLLEPNVFGKDPPQNLSELHLQQ

SEQ ID NO: 170796 - protein, 143 aa, Heterodera glycines
  Homolog annotation: Hit_ID=AAP30835.1; Match level="QueryCoverage =100%, HitCoverage=100%, E-value=3e-78, Identity=82%"; Hit description=putative gland protein G33E05; Hg-G33E05 [Heterodera glycines]
  Coding regions on vcDNA: vcDNA=SeqID_97219; Strand=+; Position=65-493
MRTFLFIAVVGLVLAVIMESVNATGNNSPTKGQTPPGSPKGGHGSNKSPTTPHSAGSPHGTQHGSQQNHATGQTPPGSPKGGHGNNKSPTTPHSAGSPHGTQHGNQQKGGHGNNKSPTTPHSAGSPHGTQHGNQQKNATGQTP

SEQ ID NO: 170797 - protein, 112 aa, Heterodera glycines
  Coding regions on vcDNA: vcDNA=SeqID_97220; Strand=-; Position=58-396
FETLYFSFEILHSNLKLVFHCVYLPFDKCEAVPYFISKLFYHFFHCLFPFDDTWQQKVVQQPTGREHIRDGIFGRDERHNFEQQFERKAFGGHCWEKQTVLLFGVISEQLAD

SEQ ID NO: 170798 - protein, 104 aa, Heterodera glycines
  Homolog annotation: Hit_ID=XP_394559.1; Match level="QueryCoverage =89%, HitCoverage=50%, E-value=2e-29, Identity=61%"; Hit description =similar to ADP-ribosylation factor-like 2 [Apis mellifera]
  Gene Ontology: Mol. function=ATP binding; Cellular component =microtubule cytoskeleton; Biological process=small GTPase mediated signal transduction
  Coding regions on vcDNA: vcDNA=SeqID_97221; Strand=+; Position=43-354
GFNIETLEFMGWKLNCWDVGGQKSLRTYWRNYFERTDAVIWVVDACDVCRLDDCFNELHSLINEECLHGVTLLVLANKRDLPGSINAHEIEKVGGKCEFGVGEI

SEQ ID NO: 170799 - protein, 45 aa, Heterodera glycines; identical to SEQ ID NO: 167940
  Homolog annotation: Hit_ID=NP_500424.2; Match level="QueryCoverage =64%, HitCoverage=4%, E-value=1e-09, Identity=86%"; Hit description =zinc finger plus homeodomain, Axon Guidance ZAG-1, ZAG-1 (zag-1) [Caenorhabditis elegans]
  Gene Ontology: Biological process=mesoderm development
  Coding regions on vcDNA: vcDNA=SeqID_97222; Strand=+; Position=3-140

SEQ ID NO: 170800 - protein, 118 aa, Heterodera glycines
  misc_feature (62)..(62): Xaa can be any naturally occurring amino acid
  misc_feature (90)..(90): Xaa can be any naturally occurring amino acid
  Homolog annotation: Hit_ID=AAL78212.1; Match level="QueryCoverage =97%, HitCoverage=100%, E-value=2e-30, Identity=53%"; Hit description= putative esophageal gland cell secretory protein Hgg-25 [Heterodera glycines]
  Coding regions on vcDNA: vcDNA=SeqID_97223; Strand=+; Position=68-423
MRTFLFIAVVGLMLAVILENVNATGKNSPSKGKPSSDSTNHKKDHKNEHPKYDSPILAGSSXVRKKENRRMPIRKKAASHHVPVTPGKVXEQSLKMVKKLCGTMMPTMNKPKAVVVDV

SEQ ID NO: 170801 - protein, 179 aa, Heterodera glycines
  Homolog annotation: Hit_ID=CAE67560.1; Match level="QueryCoverage =77%, HitCoverage=26%, E-value=7e-48, Identity=64%"; Hit description =Hypothetical protein CBG13087 [Caenorhabditis briggsae]
  Gene Ontology: Mol. function=glutamate-gated chloride channel activity; Cellular component=integral to plasma membrane; Biological process=synaptic transmission
  Coding regions on vcDNA: vcDNA=SeqID_97224; Strand=+; Position=4-540
MITPSSNTSHYRESWYACHVPVRNSRVDIIIIMAANTTHYRGPVVVTTSLFVNSISAVSERNMEYVVQFRFQQEWLDDRLAYSRLGDERSFAHLFVARDQTIWIPDSFFQNERSGHYHMLDQENRFVKIRADGRVTYNRRLTLTLACNMNLLRYPMDVQSCLIDFASYAYTTNDIIYKW

SEQ ID NO: 170802 - protein, 120 aa, Heterodera glycines
  Coding regions on vcDNA: vcDNA=SeqID_97225; Strand=-; Position=2-361
MECSDFSDGLKVETMSSENTSSAIESSVCCCCWCSATGSTATTIPFPDDMVETEEFGKDFAECEAIESSSGILSTSANVLCVKAELRTKLFAEITSTSSSSSSPLCRLPCTDCAFGVHSP

SEQ ID NO: 170803 - protein, 80 aa, Heterodera glycines; identical to SEQ ID NO: 167934
  Coding regions on vcDNA: vcDNA=SeqID_97226; Strand=+; Position=1-243

SEQ ID NO: 170804 - protein, 67 aa, Heterodera glycines
  Homolog annotation: Hit_ID=CAE66579.1; Match level="QueryCoverage =77%, HitCoverage=7%, E-value=1e-10, Identity=65%"; Hit description =Hypothetical protein CBG11896 [Caenorhabditis briggsae]
  Coding regions on vcDNA: vcDNA=SeqID_97227; Strand=+; Position=1-204
QETEKQLKVARDFINNEMGQEARMQWVSDVPLNLTKEEMQMAKERFNQLEKDKTKPVLDVVRSGGGF

SEQ ID NO: 170805 - protein, 85 aa, Heterodera glycines
  Coding regions on vcDNA: vcDNA=SeqID_97228; Strand=-; Position=0-254
FPLFLRSHFFPLITFLLRFSYLITFSSAFPLITFLLRFSFDHFSSSSVPPITFLLRFSSLITFSSAFPLITFLLRFSFDHFSSSS

SEQ ID NO: 170806 - protein, 30 aa, Heterodera glycines
  Coding regions on vcDNA: vcDNA=SeqID_97229; Strand=-; Position=56-148
FFFFFFFFFFFFFFFFVYFFSFINESTEFY

SEQ ID NO: 170807 - protein, 131 aa, Heterodera glycines
  Coding regions on vcDNA: vcDNA=SeqID_97230; Strand=+; Position=3-395
RFDLSMILVTATLASDSTPGTHVLDNSDVGFLSNGNANCTLFERWASYVGNMNSVSIMDCVAAARQGDMGQDIPNTALGLFKWCTACFGKSVGPGHSAGTATAGRKLADAAYADEAAINEHRVGKHLLKRV

SEQ ID NO: 170808 - protein, 111 aa, Heterodera glycines
  Coding regions on vcDNA: vcDNA=SeqID_97231; Strand=+; Position=3-338
TIPKQHTLGPAPKWRKGNVSNGYSPLPAAAISFLRMGRCRRKFKRNVDHQPNEGIQIPFTFACSNKSFNKWRTLGFGFNVLNLSPPFDVHLFFVFSRNSSPTAISLFILYV

SEQ ID NO: 170809 - protein, 169 aa, Heterodera glycines
  Homolog annotation: Hit_ID=AAL93203.1; Match level="QueryCoverage =62%, HitCoverage=15%, E-value=1e-11, Identity=42%"; Hit description =transposase [Bactrocera dorsalis]
  Coding regions on vcDNA: vcDNA=SeqID_97232; Strand=+; Position=1-507
IMSDSAANMKRAFVERDENENRILPIPNGPCAAHLLNLAVQEAFKRDESISSLLAKTRHIVGRFKHSNTAFSELKKIQKLLDAPSHTLLQMVYVRWNSALTMCERLTEQRTAITQYAVENNEFELVGVLKCAEEATKRFTEEPISFVLPQARSLHDELHEMKIVHRTVE

SEQ ID NO: 170810 - protein, 177 aa, Heterodera glycines
  Homolog annotation: Hit_ID=CAE59685.1; Match level="QueryCoverage =97%, HitCoverage=33%, E-value=2e-30, Identity=35%"; Hit description =Hypothetical protein CBG03108 [Caenorhabditis briggsae]
  Coding regions on vcDNA: vcDNA=SeqID_97233; Strand=+; Position=1-534
APDGQRICTSTTAPRLRTDNGFKLWTYRGDFVYEQKYDREELWEIKWRPCAAYNKFKIEEPNREQSTSNSSRINDGNAKTPFDNLPKGSLTQTARYVPPHLRGKPQKKEEKGKNETNSEETDVGKKIRTLQKKLDDISKLKTKRAAGHQLELNQMDKIRNEDRLLEEMERLTATANC

SEQ ID NO: 170811 - protein, 49 aa, Heterodera glycines
  misc_feature (40)..(40): Xaa can be any naturally occurring amino acid
  Coding regions on vcDNA: vcDNA=SeqID_97234; Strand=+; Position=3-149
DLLCIRDRICDLYLYVLSCIHLAVVISFTCIFQTNMNNFXKKKKKKKKK

SEQ ID NO: 170812 - protein, 128 aa, Heterodera glycines
  Coding regions on vcDNA: vcDNA=SeqID_97235; Strand=+; Position=2-385
QKKRISKTGEGEEEEGEELIQQEDDLQSVESQNENCRADFCLDRHDHQQNGNAADDDDDDDECCDQEKLKLIEQQETMTTAEAPLEAKGRPRPAMLQIHTVQPYQSAEKVKSPAPNAAADEAFLGQMR

SEQ ID NO: 170813 - protein, 72 aa, Heterodera glycines
  misc_feature (72)..(72): Xaa can be any naturally occurring amino acid
  Coding regions on vcDNA: vcDNA=SeqID_97236; Strand=+; Position=20-235
SRHGKWSGQVEQKERGKVRQSLVVDVLALHAHLFYFLKLSNKSGSFSHNHFPLLIFYFPCFFICNKFVYFFX

SEQ ID NO: 170814 - protein, 110 aa, Heterodera glycines
  Homolog annotation: Hit_ID=AAB08752.1; Match level="QueryCoverage =90%, HitCoverage=19%, E-value=2e-11, Identity=34%"; Hit description =LIM-homeobox domain protein
  Gene Ontology: Mol. function=DNA binding; Cellular component=nucleus; Biological process=central nervous system development
  Coding regions on vcDNA: vcDNA=SeqID_97237; Strand=+; Position=64-393
MKQQSVDSFIPSSNSLQICGGCEMRIEERHSLCVHRPRHFANFDRETEAEYWHENCLKCCQCERRLGTGEKCFVRDGRVYCREDHSKSFGTSSCQPNCARCAIPIEPAEL

SEQ ID NO: 170815 - protein, 69 aa, Heterodera glycines
  Homolog annotation: Hit_ID=CAG12678.1; Match level="QueryCoverage =85%, HitCoverage=13%, E-value=5e-18, Identity=64%"; Hit description =unnamed protein product [Tetraodon nigroviridis]
  Coding regions on vcDNA: vcDNA=SeqID_97238; Strand=+; Position=2-211
FLRNSKGLSEELVHWCHGASGVLHLLIVASLEFKEDKYLESAERCVNLIWARGILRKGPGICHGVAGEL

SEQ ID NO: 170816 - protein, 111 aa, Heterodera glycines
  Coding regions on vcDNA: vcDNA=SeqID_97239; Strand=+; Position=65-397
MRKSGVESSADTLSPASSSAELSSRLLNANPVWSVYSSSNPYSYWPYRYLTDPNSHEVFWHDVHSQFSALRRLDLFGKHKPPVDYMANNHFWTYPYPYWARHRGYLFDYAN

SEQ ID NO: 170817 - protein, 54 aa, Heterodera glycines
  Coding regions on vcDNA: vcDNA=SeqID_97240; Strand=-; Position=2-163
FFFFFFFFFFFFFFFFFFFFLIHNFMSQKSKTTTLHFAYFRTKSSRIYFTSGSK

SEQ ID NO: 170818 - protein, 171 aa, Heterodera glycines
  misc_feature (166)..(166): Xaa can be any naturally occurring amino acid
  Homolog annotation: Hit_ID=XP_309756.1; Match level="QueryCoverage =100%, HitCoverage=62%, E-value=1e-23, Identity=36%"; Hit description= ENSANGP00000012467 [Anopheles gambiae]
  Gene Ontology: Cellular component=cytoplasm; Biological process =autophagy
  Coding regions on vcDNA: vcDNA=SeqID_97241; Strand=+; Position=3-515
WPITVHLKNFPDELIRCRTKETLKFCFLQSLKEACQLKLGSNIAASMTKDEHGRLFDGLCNDRFNDFWMVNDKLMGLRSSSGEEQFSTIPARFYESSYSFRQLLLHSKKQLDDGNMGEVLLIDALHKVFPDYAIETDFEAVTHGILLPLNTPLIWLARNLVYPDNXAHIVI

SEQ ID NO: 170819 - protein, 130 aa, Heterodera glycines
  Coding regions on vcDNA: vcDNA=SeqID_97242; Strand=+; Position=3-392
CIATYETDGQAQLARERLHNVVWPVASDLALCVEFSTEEKLNRRKAEEEQEASANNSALGGGLGLTIVVDNRGRGPETVPNSGPTVLIQHDKKRQKDAENRKRKVEELEKSQKTLDEVFKKTKTLPAIYF

SEQ ID NO: 170820 - protein, 89 aa, Heterodera glycines
  Homolog annotation: Hit_ID=EAL26321.1; Match level="QueryCoverage =87%, HitCoverage=32%, E-value=8e-29, Identity=74%"; Hit description =GA20189-PA [Drosophila pseudoobscura]
  Gene Ontology: Mol. function=ubiquitin conjugating enzyme activity; Cellular component=proteasome complex (sensu Eukarya); Biological process=histone ubiquitination
  Coding regions on vcDNA: vcDNA=SeqID_97243; Strand=+; Position=1-397
LGQLIANFYIHFRNTLYDSEIFQLQFRFDDQYPFSSPEVMFMGENIPVHPHVYSNGHICLSILSDDWTLALSVSSVCLSIQSMLSSCKE

SEQ ID NO: 170821 - protein, 132 aa, Heterodera glycines
  Coding regions on vcDNA: vcDNA=SeqID_97244; Strand=+; Position=2-397
SAGNGVQKRTVSPSNSVGSSNGSGSVSSKFQSQDLISELSDRLSKRKMTVEASSNANGTPNQPNSQTLPVNNAKGSANPYGRIPSVSSLSSQDDATAGGGTPATAGAASAAQDSQLTCETVVKGPTQLTCEP

SEQ ID NO: 170822 - protein, 109 aa, Heterodera glycines
  Coding regions on vcDNA: vcDNA=SeqID_97245; Strand=+; Position=1-330
SKFHLENSINSILKWLHHRLNWFRFQCFCSSFALAWPLSRPKLIMAGVATAMSILTDFMANGKPVLVHPKMLALLVAVEKEIPTEEEEEEEDHHHQTIFERKKELQNQN

SEQ ID NO: 170823 - protein, 29 aa, Heterodera glycines
  Coding regions on vcDNA: vcDNA=SeqID_97246; Strand=-; Position=59-148
FFFFFFFFFFFFFFFFFFFFFFHSSNLFT

SEQ ID NO: 170824 - protein, 123 aa, Heterodera glycines; identical to SEQ ID NO: 164205
  Homolog annotation: Hit_ID=CAE66579.1; Match level="QueryCoverage =85%, HitCoverage=14%, E-value=9e-44, Identity=79%"; Hit description =Hypothetical protein CBG11896 [Caenorhabditis briggsae]
  Gene Ontology: Mol. function=calcium ion binding; Cellular component =mitochondrion; Biological process=glucose catabolism
  Coding regions on vcDNA: vcDNA=SeqID_97247; Strand=+; Position=2-373

SEQ ID NO: 170825 - protein, 94 aa, Heterodera glycines
  Coding regions on vcDNA: vcDNA=SeqID_97248; Strand=+; Position=178-462
RLGQFLGIVIVAVKPQIFPGFLDELRKNGWLNFVGPEVLCVSIMAGIALDTFKQQLKLVGFNGHAARFMPNVNCLVSAGIVLVCADDCVPTEMV

SEQ ID NO: 170826 - protein, 149 aa, Heterodera glycines
  Coding regions on vcDNA: vcDNA=SeqID_97249; Strand=+; Position=3-452
TNFEPNRTYTLTGIYEQSTKIDPPQSETNFVIMHKSEQTRQIMKWALLCAAEPDCMVPIGQTKACIYTATAPNLTCHRQDQSLMEILRYNMEYRQEIENPSFLTQLNPAHPRSSNRPLQSSGISGFFDLLRGKHFGGSQSEWLQRVQCC

SEQ ID NO: 170827 - protein, 30 aa, Heterodera glycines
  Coding regions on vcDNA: vcDNA=SeqID_97250; Strand=-; Position=84-176
FKPWAKKNFFPIKLKIFIPKNFFKKPLKRF

SEQ ID NO: 170828 - protein, 44 aa, Heterodera glycines; identical to SEQ ID NO: 167900
  Coding regions on vcDNA: vcDNA=SeqID_97251; Strand=+; Position=2-136

SEQ ID NO: 170829 - protein, 49 aa, Heterodera glycines; identical to SEQ ID NO: 164203
  Coding regions on vcDNA: vcDNA=SeqID_97252; Strand=+; Position=8-157

SEQ ID NO: 170830 - protein, 44 aa, Heterodera glycines; identical to SEQ ID NO: 164159
  Coding regions on vcDNA: vcDNA=SeqID_97253; Strand=+; Position=2-136

SEQ ID NO: 170831 - protein, 39 aa, Heterodera glycines
  Coding regions on vcDNA: vcDNA=SeqID_97254; Strand=-; Position=3-119
FFFFFFFFFFFFFFFFFFLKFYCLFASLGFFQKCLLIIF

SEQ ID NO: 170832 - protein, 133 aa, Heterodera glycines
  Coding regions on vcDNA: vcDNA=SeqID_97255; Strand=+; Position=3-401
NQGMNQLALPRKAKKTNKTNAIVPVQNAASFGDRGYIPSSEIILKTKQKRRPEASAEEYIKFVKNAVNSLNKSDNVHFLTNGFSLVGKNAQQELQRYHIYPRNRLMIGGLMELIANRKMKSADELEYMVLEKV

SEQ ID NO: 170833 - protein, 38 aa, Heterodera glycines
  Homolog annotation: Hit_ID=ZP_00357698.1; Match level="QueryCoverage =94%, HitCoverage=25%, E-value=1e-13, Identity=92%"; Hit description =hypothetical protein Chlo02002738 [Chloroflexus aurantiacus]
  Coding regions on vcDNA: vcDNA=SeqID_97256; Strand=-; Position=20-136
LFFFFFFFFFFFFFFFFFFFFFFFFFFFFFFFFLDVEI

SEQ ID NO: 170834 - protein, 114 aa, Heterodera glycines
  Homolog annotation: Hit_ID=NP_741446.1; Match level="QueryCoverage =92%, HitCoverage=65%, E-value=4e-37, Identity=67%"; Hit description =serine/aRginine rich pre-mRNA SPlicing factor, Serpin (20.5 kD) (rsp- 6) [Caenorhabditis elegans] gb|AAA82
  Gene Ontology: Mol. function=pre-mRNA splicing factor activity; Cellular component=nuclear speck; Biological process=mRNA splice site selection
  Coding regions on vcDNA: vcDNA=SeqID_97257; Strand=+; Position=52-393
MSSRRNEYLDAKIYVGGLPEDATSEELDDAFHRFGRIRKIWVARRPPGFAFVEFEDARDAEDAVRALDGTRICGVKARVELSHGSGRGGGRGFRGGGGRYDDRYGRDRYDRDRD

SEQ ID NO: 170835 - protein, 49 aa, Heterodera glycines
  Coding regions on vcDNA: vcDNA=SeqID_97258; Strand=-; Position=3-149
FFFFFFFFFFFFFFFFFFFFIFGICGLQNRTIKKSIRCPITFCNSSVCQ

SEQ ID NO: 170836 - protein, 39 aa, Heterodera glycines
  Coding regions on vcDNA: vcDNA=SeqID_97259; Strand=+; Position=1-120
EKEERKEVEKAAWINESKAKQYLLNILFFGKIFPIFHFQ

SEQ ID NO: 170837 - protein, 43 aa, Heterodera glycines
  Coding regions on vcDNA: vcDNA=SeqID_97260; Strand=+; Position=2-133
IMQSKQKPTLSPPPGDYDAFIAFSRLFFAAFKMLNFKNKNKFF

SEQ ID NO: 170838 - protein, 131 aa, Heterodera glycines
  Homolog annotation: Hit_ID=NP_500001.2; Match level="QueryCoverage =83%, HitCoverage=18%, E-value=6e-18, Identity=43%"; Hit description =ankyrin (4B602) [Caenorhabditis elegans] gb|AAF59601.3| Hypothetical protein Y55F3BR.8a [Caenorhabditis e
  Coding regions on vcDNA: vcDNA=SeqID_97261; Strand=+; Position=1-393
EFRVAIEKGDAAKFDGLLRESPRFLVNTSNDLPTILHIGMRCNAMHIACRSSNVHAVRQMLALVQSGEWLRDAYGTDACVKERSDNLLDALLNTPDKIENNTPLHYACRQLCEPIFRELIGHEQCHRSPVN

SEQ ID NO: 170839 - protein, 52 aa, Heterodera glycines
  Coding regions on vcDNA: vcDNA=SeqID_97262; Strand=-; Position=1-156
RFVLRFLFKWKSFGTFVVDERKMANSEEKVEQMLCLFSKRFAPPKTFFPSFS

SEQ ID NO: 170840 - protein, 52 aa, Heterodera glycines
  misc_feature (51)..(52): Xaa can be any naturally occurring amino acid
  Coding regions on vcDNA: vcDNA=SeqID_97263; Strand=+; Position=52-207
KRIYQNIIKFLFISHIIPHRFACYVCRSILSFSPNSLKWKIYKKLNKGLIXX

SEQ ID NO: 170841 - protein, 150 aa, Heterodera glycines
  Coding regions on vcDNA: vcDNA=SeqID_97264; Strand=-; Position=1-450
VSVSDGRSMGTFASPSSKKSPGPSAISCWLNCSLSLICSIILASRLRLCSSTICSMEGANSVWYCWLGCCNSLSRRSAGESKVGGSFGMGGELSEERTGKEPPSEKGTNQTIKAFLTGIEMVGGASDTKEKCGDHRQWAKNNRREFPRNC

SEQ ID NO: 170842 - protein, 57 aa, Heterodera glycines
  Coding regions on vcDNA: vcDNA=SeqID_97265; Strand=+; Position=1-174
RRLFHRKDWIINPLCAESELTDRHAMLRFYHPTHSFSVIFASAVSFPFCCLFCDGFN

SEQ ID NO: 170843 - protein, 88 aa, Heterodera glycines
  Homolog annotation: Hit_ID=NP_741899.1; Match level="QueryCoverage =97%, HitCoverage=49%, E-value=7e-33, Identity=77%"; Hit description =leftover like (XL616) [Caenorhabditis elegans] emb|CAD36494.1| Hypothetical protein F59F3.6 [Caenorhabdit
  Coding regions on vcDNA: vcDNA=SeqID_97266; Strand=+; Position=130-393
AIPTDKGGNLFLDRDPKMFRHIIGYLRLKKERCAASLALPAKPDDLAKLIGECEALNLVELRELALEMLQKYVRTEEQHYVTSYVQMA

SEQ ID NO: 170844 - protein, 196 aa, Heterodera glycines
  Homolog annotation: Hit_ID=AAO49799.1; Match level="QueryCoverage =100%, HitCoverage=60%, E-value=1e-107, Identity=89%"; Hit description=arginine kinase [Heterodera glycines]
  Gene Ontology: Mol. function=creatine kinase activity; Cellular component=mitochondrion; Biological process=muscle contraction
  Coding regions on vcDNA: vcDNA=SeqID_97267; Strand=+; Position=1-591
LTKENYVEMESKVKAVFEQLKGDADHFLFKEGDRFLQEANACRYWPTGRGIFHNAKKTFLVWVNEEDHLRIISMQNGGNVGQVLERLIKGVKAIESKVPFSRDDRLGWLTFCPTNLGTTVRASVHIRLPKISAKPDFKSICDGLKLQIRGIHGEHSESAGGVYDISNKARLGLTEFEAVKQMYDGVKHLIELEKKA

SEQ ID NO: 170845 - protein, 30 aa, Heterodera glycines
  Coding regions on vcDNA: vcDNA=SeqID_97268; Strand=-; Position=62-154
LFFFFFFFFFFFFFFFFFFLITTLVFKTNI

SEQ ID NO: 170846 - protein, 71 aa, Heterodera glycines
  Homolog annotation: Hit_ID=AAA73456.2; Match level="QueryCoverage =43%, HitCoverage=27%, E-value=1e-09, Identity=93%"; Hit description =beta-galactosidase alpha peptide [Cloning vector pSport1]
  Coding regions on vcDNA: vcDNA=SeqID_97269; Strand=+; Position=1-216
TMITPSSNTTHYRESWYAFTYRSGIPGSTSSSSWPLILLTIGGGGDGIAQHWHALISLNRPVAIIHTPGFR

SEQ ID NO: 170847 - protein, 169 aa, Heterodera glycines
  Homolog annotation: Hit_ID=NP_496505.1; Match level="QueryCoverage =86%, HitCoverage=27%, E-value=1e-60, Identity=73%"; Hit description =ALDH6A3, ALdehyde deHydrogenase (56.5 kD) (alh-8) [Caenorhabditis elegans] emb|CAA88946.1| Hypothetical p
  Gene Ontology: Mol. function=methylmalonate-semialdehyde dehydrogenase (acylating) activity; Cellular component =mitochondrion; Biological process=pyrimidine nucleotide metabolism
  Coding regions on vcDNA: vcDNA=SeqID_97270; Strand=+; Position=2-508
AEGDVFRGLQVVEFACNAASLLLGEHLPNIAKDMETYSLRLPLGVTAGICPFNFPAMIPLWMFPLALVSGNTMLMKPSEQDPGATMMLMELAKEAGIPDGCVNVIHGTRSAVTFICEQPDIKAISFVGSDQAGKYIYEHGSKFDKQKSLRKWHCPFHSVGNCRAPFRLG

SEQ ID NO: 170848 - protein, 119 aa, Heterodera glycines
  Homolog annotation: Hit_ID=AAN32884.1; Match level="QueryCoverage =100%, HitCoverage=35%, E-value=2e-64, Identity=97%"; Hit description= cellulase ENG-5 [Heterodera glycines] gb|AAP97436.1| cellulase ENG-5 [Heterodera glycines]
  Coding regions on vcDNA: vcDNA=SeqID_97271; Strand=+; Position=3-362
ANIIYTMHFYAGQHKDDIRNKVKTAYKLGLPMFVTEYGCYSADGNEKANLEELKKWMELLDGYGISYAAWHVADIGEQSSILTKSSEVNNICDPAHLTNYGEAIINKLKSQNNGVKCSG

SEQ ID NO: 170849 - protein, 118 aa, Heterodera glycines
  Homolog annotation: Hit_ID=AAH71093.1; Match level="QueryCoverage =77%, HitCoverage=29%, E-value=4e-11, Identity=38%"; Hit description =MGC81101 protein [Xenopus laevis]
  Gene Ontology: Biological process=autophagy
  Coding regions on vcDNA: vcDNA=SeqID_97272; Strand=+; Position=5-361
MANYCSFKRFSKSIEFIFAIRSHENLQNFPDELIRCRTKETLKFCFLQSLKEACQLKLGSNIAASMTKDEHGRLFDGLCNDRFNDFWMVNDKLMGLRSSSGEEQFSTIPARFYEVLIY

SEQ ID NO: 170850 - protein, 83 aa, Heterodera glycines; identical to SEQ ID NO: 164182
  Homolog annotation: Hit_ID=XP_510031.1; Match level="QueryCoverage =83%, HitCoverage=68%, E-value=1e-17, Identity=61%"; Hit description =PREDICTED: similar to enhancer of rudimentary homolog [Pan troglodytes] gb|AAH86103.1| Unknown (protein f
  Coding regions on vcDNA: vcDNA=SeqID_97273; Strand=+; Position=5-256

SEQ ID NO: 170851 - protein, 49 aa, Heterodera glycines
  Coding regions on vcDNA: vcDNA=SeqID_97274; Strand=+; Position=35-181
CLLIINVLICKKKKKKKKKKKKLKRSYHCLKKQKEAASRGTKITQLLCC

SEQ ID NO: 170852 - protein, 52 aa, Heterodera glycines
  Coding regions on vcDNA: vcDNA=SeqID_97275; Strand=-; Position=2-157
CSFFPLKEPFLPPLKPLTNQFYSPKFVTQFCTLESVAHPSLLIFILYFCPSP

SEQ ID NO: 170853 - protein, 37 aa, Heterodera glycines
  misc_feature (32)..(32): Xaa can be any naturally occurring amino acid
  Homolog annotation: Hit_ID=ZP_00357698.1; Match level="QueryCoverage =100%, HitCoverage=21%, E-value=2e-13, Identity=89%"; Hit description= hypothetical protein Chlo02002738 [Chloroflexus aurantiacus]
  Coding regions on vcDNA: vcDNA=SeqID_97276; Strand=-; Position=48-161
FFFFFFFFFFFFFFFFFFFFFFFFFFFFFFFXICSLI

SEQ ID NO: 170854 - protein, 43 aa, Heterodera glycines
  Coding regions on vcDNA: vcDNA=SeqID_97277; Strand=-; Position=2-130
YNTIIGAHTNHVECFWKNLKMKFKAISGTSRELLLSYCDEYMW

SEQ ID NO: 170855 - protein, 73 aa, Heterodera glycines
  Coding regions on vcDNA: vcDNA=SeqID_97278; Strand=+; Position=18-236
TDREEEGREIRFWWRTNAEEWEKDTGKVKAIANKKNDELMTTPSLSNIKWKEKQRATIHPILLFITAIKANNY

SEQ ID NO: 170856 - protein, 117 aa, Heterodera glycines
  Homolog annotation: Hit_ID=CAE60401.1; Match level="QueryCoverage =94%, HitCoverage=30%, E-value=1e-24, Identity=47%"; Hit description =Hypothetical protein CBG04003 [Caenorhabditis briggsae]
  Gene Ontology: Mol. function=translation factor activity, nucleic acid binding; Cellular component=eukaryotic translation initiation factor 3 complex; Biological process=positive regulation of growth rate
  Coding regions on vcDNA: vcDNA=SeqID_97279; Strand=+; Position=3-356
MKALIGTVDELNKAVNAYGKYTVEKQKYDTMYNNLMQKRQTENEARQSRGEPPLTMEDIKRQLKQPQMQTKYGMLDLLLNALDTDAFTTYQIQTTNENVAKLHLSQAVSAQPNLERK

SEQ ID NO: 170857 - protein, 107 aa, Heterodera glycines; identical to SEQ ID NO: 164180
  Coding regions on vcDNA: vcDNA=SeqID_97280; Strand=+; Position=2-325

SEQ ID NO: 170858 - protein, 91 aa, Heterodera glycines; identical to SEQ ID NO: 167864
  Coding regions on vcDNA: vcDNA=SeqID_97281; Strand=-; Position=85-360

SEQ ID NO: 170859 - protein, 55 aa, Heterodera glycines; identical to SEQ ID NO: 167863
  Coding regions on vcDNA: vcDNA=SeqID_97282; Strand=-; Position=13-180

SEQ ID NO: 170860 - protein, 50 aa, Heterodera glycines
  Coding regions on vcDNA: vcDNA=SeqID_97283; Strand=-; Position=1-150
FFFFFIHSVALFVLSIPFFIFFLSLLPSSPCFHIFVLSFFFVCFNFYFQF

SEQ ID NO: 170861 - protein, 131 aa, Heterodera glycines
  Homolog annotation: Hit_ID=NP_498138.2; Match level="QueryCoverage =98%, HitCoverage=26%, E-value=1e-13, Identity=35%"; Hit description =putative cytoplasmic protein of bilaterial origin (50.0 kD) (3G415) [Caenorhabditis elegans] gb|AAA81060.
  Coding regions on vcDNA: vcDNA=SeqID_97284; Strand=+; Position=2-468
RVLDSSEADCIFLVGGDGTLSRALVGLSQNSAPLPIGLFPGGRKNIAFWRIFQSKNQSRDSKSVRMFCESAMALIEGENRLVYPVKCSITEEMNDSPSDHQTVNTPNTFWLLSDLCAGWFEHCEQKAPKLW

SEQ ID NO: 170862 - protein, 50 aa, Heterodera glycines
  Homolog annotation: Hit_ID=NP_957365.1; Match level="QueryCoverage =96%, HitCoverage=26%, E-value=1e-10, Identity=58%"; Hit description =similar to MCT-1 protein [Danio rerio] gb|AAH46019.1| Similar to MCT- 1 protein [Danio rerio]
  Gene Ontology: Biological process=regulation of cell cycle
  Coding regions on vcDNA: vcDNA=SeqID_97285; Strand=+; Position=59-211
VAIMAEGKQHAMGIGQMKLSSANVRSQNVGIAIDNVHFMNDGLWRLTTVQ

SEQ ID NO: 170863 - protein, 50 aa, Heterodera glycines
  Homolog annotation: Hit_ID=ZP_00357698.1; Match level="QueryCoverage =70%, HitCoverage=18%, E-value=2e-09, Identity=74%"; Hit description =hypothetical protein Chlo02002738 [Chloroflexus aurantiacus]
  Coding regions on vcDNA: vcDNA=SeqID_97286; Strand=-; Position=1-150
FFFFFFFFFFFFFFFFFFFFFFFLSIYMCFIKSFLQQLKKSSLQKFAISP

SEQ ID NO: 170864 - protein, 28 aa, Heterodera glycines
  misc_feature (27)..(27): Xaa can be any naturally occurring amino acid
  Homolog annotation: Hit_ID=ZP_00357698.1; Match level="QueryCoverage =92%, HitCoverage=18%, E-value=6e-10, Identity=97%"; Hit description =hypothetical protein Chlo02002738 [Chloroflexus aurantiacus]
  Coding regions on vcDNA: vcDNA=SeqID_97287; Strand=-; Position=63-149
FFFFFFFFFFFFFFFFFFFFFFFFFFXV

SEQ ID NO: 170865 - protein, 80 aa, Heterodera glycines; identical to SEQ ID NO: 164170
  Coding regions on vcDNA: vcDNA=SeqID_97288; Strand=+; Position=87-329

SEQ ID NO: 170866 - protein, 70 aa, Heterodera glycines; identical to SEQ ID NO: 167847
  Coding regions on vcDNA: vcDNA=SeqID_97289; Strand=-; Position=17-229

SEQ ID NO: 170867 - protein, 51 aa, Heterodera glycines
  Coding regions on vcDNA: vcDNA=SeqID_97290; Strand=+; Position=13-168
SAETAFSAEGTDRTKSLNCEIGHSFVILIFHFFYLWPFSENTQNLIDLIKK

SEQ ID NO: 170868 - protein, 122 aa, Heterodera glycines
  Homolog annotation: Hit_ID=AAN32890.1; Match level="QueryCoverage =100%, HitCoverage=73%, E-value=9e-62, Identity=99%"; Hit description= secretory protein 4D09 [Heterodera glycines]
  Coding regions on vcDNA: vcDNA=SeqID_97291; Strand=+; Position=29-394
MAKFVAIALLSLTIVSMALAKTGKSQTADEVEGFRNMNIGDNNKVDAGKEPAADKATKKGKAQKAGTKPAAATNEPAAAKGTKNGKAPKTKAKQEVATNEPAAANEWNDQLMGMSVEKFNEE

SEQ ID NO: 170869 - protein, 179 aa, Heterodera glycines
  Coding regions on vcDNA: vcDNA=SeqID_97292; Strand=+; Position=3-539
LITPSSNTHHYRESWYAFRYRSGIPGSTSSSSSWPLIPLTIGDNKNFLNSGFCGVDDLECLNLLSAFVRYVRCGGICIIDPTDLLPIERYIRLPSGVFRPVKVPTNAITPLLTSEVNDNSAAVATLTDGRLALFTTDHFDSIADDSATFLPFSTTLSGGMMLDCAVKSDGRLLCSDNLG

SEQ ID NO: 170870 - protein, 178 aa, Heterodera glycines
  Homolog annotation: Hit_ID=CAE61993.1; Match level="QueryCoverage =79%, HitCoverage=21%, E-value=2e-32, Identity=49%"; Hit description =Hypothetical protein CBG06001 [Caenorhabditis briggsae]
  Gene Ontology: Mol. function=ubiquitin-like conjugating enzyme activity; Cellular component=cytoplasm; Biological process=membrane fusion
  Coding regions on vcDNA: vcDNA=SeqID_97293; Strand=+; Position=8-544
LRQALILLTIGKAGTPAVPVRNSRVDIIIIIIIMAANTTHYRALDQQCTISRSGISMIASGIATELLASVLQHELGAEAPALLAEVDENASQLGATPHQIRGFMSRFHLMMPTVRRYDRCTACGHTVKQFYRTEGFEFLNRIFQCPAELEQITGLAELQRQADAFQSEVIEMDDSESI

SEQ ID NO: 170871 - protein, 112 aa, Heterodera glycines
  misc_feature (43)..(43): Xaa can be any naturally occurring amino acid
  Homolog annotation: Hit_ID=AAC15708.1; Match level="QueryCoverage =94%, HitCoverage=27%, E-value=1e-41, Identity=82%"; Hit description =beta-1,4-endoglucanase-2 precursor [Heterodera glycines]
  Coding regions on vcDNA: vcDNA=SeqID_97294; Strand=+; Position=1-339
TLHFYASSHFVDGLGNKLKTAVNKGNHMILYRPKPLLFATVLXGLPVFVTEYGTCEASGNGNLNSGSMSSWWSLLDQLKISYVNWSITDKSEACAALTGGTSAANVSDFGGH

SEQ ID NO: 170872 - protein, 61 aa, Heterodera glycines
  Coding regions on vcDNA: vcDNA=SeqID_97295; Strand=-; Position=243-428
FKFQWTTVFFVISNVKSKMPSRDLWEYGNLGILWKLGMGQICFVQLLSKLGQIFIQIKSFS

SEQ ID NO: 170873 - protein, 131 aa, Heterodera glycines
  misc_feature (93)..(93): Xaa can be any naturally occurring amino acid
  Homolog annotation: Hit_ID=CAE66444.1; Match level="QueryCoverage =97%, HitCoverage=32%, E-value=2e-35, Identity=55%"; Hit description =Hypothetical protein CBG11719 [Caenorhabditis briggsae]
  Coding regions on vcDNA: vcDNA=SeqID_97296; Strand=+; Position=2-393
GDNGMYLNIILGSNLNITLPSPDERYRYKKEYESFKLSVAFVILAVFFVVIWLPPILRPLDALCNFLLVWYYCTLTIRESILRLNGSRIKGWXLHHYITCVLCCITLTWSGGDCYEHMRPTFVVLVCYVSS

SEQ ID NO: 170874 - protein, 131 aa, Heterodera glycines
  Homolog annotation: Hit_ID=CAE66444.1; Match level="QueryCoverage =98%, HitCoverage=32%, E-value=9e-38, Identity=55%"; Hit description =Hypothetical protein CBG11719 [Caenorhabditis briggsae]
  Coding regions on vcDNA: vcDNA=SeqID_97297; Strand=+; Position=2-394
GDNGMYLNIILGSNLNITLPSPDERYRYKKEYESFKLSVAFVILAVFFVVIWLPPTLRPLDALCNFLLVWYYCTLTIRESILRLNGSRIKGWWVLHHYITCVLCCITLTWSGGDCYEHMRPTFVVLVCYVS

SEQ ID NO: 170875 - protein, 117 aa, Heterodera glycines; identical to SEQ ID NO: 164216
  Homolog annotation: Hit_ID=XP_318627.1; Match level="QueryCoverage =94%, HitCoverage=10%, E-value=1e-33, Identity=62%"; Hit description =ENSANGP00000020973 [Anopheles gambiae]
  Gene Ontology: Mol. function=ATP dependent RNA helicase activity; Cellular component=nucleolus; Biological process=RNA localization
  Coding regions on vcDNA: vcDNA=SeqID_97298; Strand=+; Position=34-387

SEQ ID NO: 170876 - protein, 206 aa, Heterodera glycines
  Homolog annotation: Hit_ID=AAH57117.1; Match level="QueryCoverage =55%, HitCoverage=63%, E-value=3e-11, Identity=34%"; Hit description =Mak3p homolog [Mus musculus]
  Coding regions on vcDNA: vcDNA=SeqID_97299; Strand=+; Position=36-656
MLLNISCLPINYGTNPRSTHYKRVTRNRLAEKGPDNGDECDTSFWTMMAYRHHFNDQNGTDCEEDASMLVGAITVSNRNSNCSCCSSNKTDGVVQPQKQMFSVQIQTLAVLPTFRRHGVATRLLNSLINQCEKWANVENIFLHCQTTNEAALCLYRAHGFEVVQQIHGHYQCRAIDGESADAFLLERRFTNENDEERKVRQNAAFH

SEQ ID NO: 170877 - protein, 60 aa, Heterodera glycines; identical to SEQ ID NO: 167834
  Coding regions on vcDNA: vcDNA=SeqID_97300; Strand=-; Position=2-181

SEQ ID NO: 170878 - protein, 43 aa, Heterodera glycines
  Coding regions on vcDNA: vcDNA=SeqID_97301; Strand=+; Position=1-132
TQRDQLEFRAQHASFGDQTYNDDEKIRKLMTALSLQFVGNAIK

SEQ ID NO: 170879 - protein, 136 aa, Heterodera glycines
  Homolog annotation: Hit_ID=CAF96400.1; Match level="QueryCoverage =100%, HitCoverage=73%, E-value=2e-49, Identity=65%"; Hit description= unnamed protein product [Tetraodon nigroviridis]
  Gene Ontology: Mol. function=protein binding; Cellular component =nucleus; Biological process=transcription-coupled nucleotide -excision repair
  Coding regions on vcDNA: vcDNA=SeqID_97302; Strand=+; Position=127-534
GEMELRHSNYELATALLRRATTPPPVRRDSYFDDSAKVQNRVFRSLKLWSLYADIEESMGSLESCKAIYERMLELRIATPQIVINYALFLEDNQYFEDAFKAFEKGIGLFRWPLVFDIWNVYLTKFIQRYGGKKLE

SEQ ID NO: 170880 - protein, 147 aa, Heterodera glycines
  misc_feature (37)..(37): Xaa can be any naturally occurring amino acid
  Homolog annotation: Hit_ID=BAA02166.1; Match level="QueryCoverage =41%, HitCoverage=8%, E-value=2e-18, Identity=75%"; Hit description =KIF3 protein [Mus musculus] sp|P28741|KF3A_MOUSE Kinesin-like protein KIF3A (Microtubule plus end-directed
  Gene Ontology: Mol. function=plus-end-directed kinesin ATPase activity; Cellular component=plus-end kinesin complex; Biological process=organelle organization and biogenesis
  Coding regions on vcDNA: vcDNA=SeqID_97303; Strand=+; Position=1-443
SERQAKINATGDRLKEASKINLSLSTLGNVISALADXESPHIPYRNSKLNRILQELLGGTAGPTVGAEQPLGKDDKINVSLNAFVGSWQWRRASEHSKQNSATLRSSTAHCRRSPRGWANDGAMDPTATTNNNQRCRKMNRNIKYQK

SEQ ID NO: 170881 - protein, 78 aa, Heterodera glycines
  Coding regions on vcDNA: vcDNA=SeqID_97304; Strand=-; Position=39-275
FFLMTNKEKQKILKWKTKIKSKERFEPCEHFHHQIPLTKTRIFWQQVEKHFQLQNLFHEAQLVPFDLLKLVPRVDFVH

SEQ ID NO: 170882 - protein, 29 aa, Heterodera glycines
  Coding regions on vcDNA: vcDNA=SeqID_97305; Strand=-; Position=203-292
FFFFFFFFFFFFFFFFFLIHYVFMQSKNR

SEQ ID NO: 170883 - protein, 51 aa, Heterodera glycines
  Coding regions on vcDNA: vcDNA=SeqID_97306; Strand=-; Position=90-245
YRHRKMCKIQGLYCFAKILMDKFNNWIFNEFQYMHRRYPILQYFICFRLTG

SEQ ID NO: 170884 - protein, 58 aa, Heterodera glycines; identical to SEQ ID NO: 164154
  Coding regions on vcDNA: vcDNA=SeqID_97307; Strand=+; Position=133-309

SEQ ID NO: 170885 - protein, 77 aa, Heterodera glycines
  Coding regions on vcDNA: vcDNA=SeqID_97308; Strand=-; Position=0-230
WKSLRIDGTNLRKRRKNLAYNSKAQMLRYRFQCPFASLEVFVDVKVKSVADQRNSEAKLRRWEQIEHRKPTIGGDET

SEQ ID NO: 170886 - protein, 131 aa, Heterodera glycines
  Homolog annotation: Hit_ID=NP_498785.1; Match level="QueryCoverage =100%, HitCoverage=5%, E-value=3e-60, Identity=78%"; Hit description =yeast splicing factor PRP related (prp-8) [Caenorhabditis elegans] gb|AAA27977.1| Yeast prp (splicing fac
  Gene Ontology: Mol. function=pre-mRNA splicing factor activity; Cellular component=snRNP U5; Biological process=mRNA splicing
  Coding regions on vcDNA: vcDNA=SeqID_97309; Strand=+; Position=1-393
HTQPNELPQLSPQDITMHSKIIHQNQWDGERSVIITCSFTPGSVSLTSYRLTPSGYEWGRNNTDKGNNPKGYLPSHYEKVQMLLSDRFLGYFMVPSAGVWNYNFMGVRHDANMQYDVCLSAPKEFYHEDHR

SEQ ID NO: 170887 - protein, 54 aa, Heterodera glycines
  Homolog annotation: Hit_ID=XP_428325.1; Match level="QueryCoverage =72%, HitCoverage=10%, E-value=2e-09, Identity=76%"; Hit description =PREDICTED: similar to Ac1147, partial [Gallus gallus]
  Coding regions on vcDNA: vcDNA=SeqID_97310; Strand=-; Position=82-246
LAHCFCGHNFLEGFSVFSRTKLSNNRSVMPLDVRGCTRATLAKSACLSFPERGW

SEQ ID NO: 170888 - protein, 118 aa, Heterodera glycines; identical to SEQ ID NO: 167815
  Coding regions on vcDNA: vcDNA=SeqID_97311; Strand=-; Position=2-355

SEQ ID NO: 170889 - protein, 121 aa, Heterodera glycines
  Coding regions on vcDNA: vcDNA=SeqID_97312; Strand=+; Position=32-394
MRSLLFLAFVALFVVKCSADESMQNDENDEQFPPGPPPSNEMSEESNDRRKRSPFFNFFGGFKKGGRGGRQKGEKPNGVPPTGSPPAEREKRSLSRGNAKMGGRGPMGGRGGQKGGRGGQK

SEQ ID NO: 170890 - protein, 143 aa, Heterodera glycines
  Coding regions on vcDNA: vcDNA=SeqID_97313; Strand=+; Position=156-584
NPSLNLKKESVLKKTFSVEAGDSLTNAILGILPQQSADDAEADSTGNGPMHSAEHHQHETDQQQQMISSGTGAASVEGNAIAAGVRRHSLLGPIPIRSQQQQSVEGQQSTIGQPMVRNLPPATVRTANFAQNHPQSLVNSQHP

SEQ ID NO: 170891 - protein, 130 aa, Heterodera glycines
  Homolog annotation: Hit_ID=CAE70013.1; Match level="QueryCoverage =88%, HitCoverage=79%, E-value=2e-09, Identity=30%"; Hit description =Hypothetical protein CBG16427 [Caenorhabditis briggsae]
  Coding regions on vcDNA: vcDNA=SeqID_97314; Strand=+; Position=32-424
MSQQNEEAPGKDQKELRAVQHDMERLFKARDAKGLSELYTVDAIFASNAHPPIKSRAEIEKLWIKFLDTDSAELHVTFDEVYFCGDLGVENGTYKFTNNDGTVTQNGLFIQTFKRGSDGKWLIHNDFYTC

SEQ ID NO: 170892 - protein, 69 aa, Heterodera glycines
  misc_feature (69)..(69): Xaa can be any naturally occurring amino acid
  Coding regions on vcDNA: vcDNA=SeqID_97315; Strand=+; Position=1-207
KLMKINYQIEMNLTNAGSLKKNTTEVLMPFFARTKHKMQKHKSSSKTRSKKFTICVKLIFLSYNKTKAX

SEQ ID NO: 170893 - protein, 55 aa, Heterodera glycines
  Coding regions on vcDNA: vcDNA=SeqID_97316; Strand=-; Position=0-164
STSTFHLPSISLTFRSTNSASYSSVSVSAGAVPPSSASELIVVVPPPPPSVVVPV

SEQ ID NO: 170894 - protein, 105 aa, Heterodera glycines
  Coding regions on vcDNA: vcDNA=SeqID_97317; Strand=+; Position=3-320
HHFKIFPKMRVLPLLFSALLLLSVGLCFAQFDQSPSAALNHVRAKRGYKPWKKQSFSSSSSEMYRRRRPSGNGHYRDYNGYGSNGYYRRKPGILERALGKITRSY

SEQ ID NO: 170895 - protein, 184 aa, Heterodera glycines
  Homolog annotation: Hit_ID=EAL28191.1; Match level="QueryCoverage =88%, HitCoverage=50%, E-value=6e-29, Identity=43%"; Hit description =GA11580-PA [Drosophila pseudoobscura]
  Gene Ontology: Mol. function=oxidoreductase activity, acting on the CH-OH group of donors, NAD or NADP as acceptor; Biological process =metabolism
  Coding regions on vcDNA: vcDNA=SeqID_97318; Strand=+; Position=3-554
QFRPQNDGFFSEDEQQKWVKEHIGEAEIIYTMGPIKVDASLLVVAKALKAVVTISAGHENIDTVECARRGIRMGFGGAILTEATAETAMALLLTVSRRLVEAVQIAKEGKWPNNWSPKFCVGKALEGSTVGIFGMGRIGRSIADKLSAFRPLEIIYHNRKANSEYEGRFRYVPFEELIERSDFL

SEQ ID NO: 170896 - protein, 79 aa, Heterodera glycines; identical to SEQ ID NO: 167858
  Homolog annotation: Hit_ID=NP_498776.1; Match level="QueryCoverage =98%, HitCoverage=70%, E-value=4e-28, Identity=73%"; Hit description =heat shock protein (hsp-12.2) [Caenorhabditis elegans] gb|AAA27953.1| Heat shock protein protein 12.2 [Ca
  Gene Ontology: Mol. function=chaperone activity; Cellular component =cytoplasm; Biological process=muscle contraction
  Coding regions on vcDNA: vcDNA=SeqID_97319; Strand=+; Position=3-298

SEQ ID NO: 170897 - protein, 45 aa, Heterodera glycines
  Coding regions on vcDNA: vcDNA=SeqID_97320; Strand=-; Position=1-135
NIKIIIIIIKSFMPTFFSVQWSSIYMMFAAVVLAQQGDENKCENV

SEQ ID NO: 170898 - protein, 30 aa, Heterodera glycines
  Coding regions on vcDNA: vcDNA=SeqID_97321; Strand=+; Position=68-160
LKKEWNVDQTISIVLFNDFCLHFNFLFPNY

SEQ ID NO: 170899 - protein, 86 aa, Heterodera glycines
  Coding regions on vcDNA: vcDNA=SeqID_97322; Strand=+; Position=2-262
LYPIKKSKSSLKMKLSIILLLSLAFCASIIDAYPSGNGKDLEADNEKTEVKEEKMEKREAEVEEGKKEKKAKGAAGEEAKEVKTRT

SEQ ID NO: 170900 - protein, 76 aa, Heterodera glycines
  Coding regions on vcDNA: vcDNA=SeqID_97323; Strand=-; Position=311-541
GGGSGNAGDAVHQNGTTVLDDGMDLICHDVKVREKVLIRRVLHPQLHRINFKTNYYIFIPLIQKWFKQLNFLTNYY

SEQ ID NO: 170901 - protein, 60 aa, Heterodera glycines; identical to SEQ ID NO: 167801
  Coding regions on vcDNA: vcDNA=SeqID_97324; Strand=+; Position=2-184

SEQ ID NO: 170902 - protein, 38 aa, Heterodera glycines
  Coding regions on vcDNA: vcDNA=SeqID_97325; Strand=+; Position=3-119
IFMELGQIAFDIFSIIDILLTLTVLLIDSQIFRKYANC

SEQ ID NO: 170903 - protein, 32 aa, Heterodera glycines
  Coding regions on vcDNA: vcDNA=SeqID_97326; Strand=+; Position=52-150
SIFIQLNFCFGVESTNNKNSKITHLKSKFLTV

SEQ ID NO: 170904 - protein, 151 aa, Heterodera glycines
  Homolog annotation: Hit_ID=AAS66238.1; Match level="QueryCoverage =92%, HitCoverage=14%, E-value=8e-45, Identity=58%"; Hit description =LRRGT00147 [Rattus norvegicus]
  Gene Ontology: Biological process=cell proliferation
  Coding regions on vcDNA: vcDNA=SeqID_97327; Strand=+; Position=1-453
SQKALEDLDKVQTELDTLNETASDEILKVEQKYNQMRKPFFEKRTHFIKQIPNFWVTVFINHPQISNILEEEEEECLHYLTKVEIEENEDIKAGYKLKFSFDPNPFFENSEIVKEFNWTAAEPNSVTTEIKWKHSTMKKMRRRTMVGMRRR

SEQ ID NO: 170905 - protein, 147 aa, Heterodera glycines
  Homolog annotation: Hit_ID=NP_609382.1; Match level="QueryCoverage =80%, HitCoverage=29%, E-value=6e-21, Identity=45%"; Hit description =CG5037-PA [Drosophila melanogaster] gb|AAF52915.1| CG5037-PA [Drosophila melanogaster] gb|AAL13868.1| LD3
  Gene Ontology: Mol. function=farnesyltranstransferase activity; Cellular component=mitochondrial inner membrane; Biological process =heme biosynthesis
  Coding regions on vcDNA: vcDNA=SeqID_97328; Strand=+; Position=2-442
RSVVSKAANNVAEQGTSSVSGNKENLLNAYLQLSKCRLTALIACTSVSGFLMSPALSSAPSSLFFSCVVGTALLSASASTCNNVIERQHDKQMKRTRSRVLPVGRLTPIHALLFAGATGTAGLGILCLSCNHLTSALGFVNLALYAG

SEQ ID NO: 170906 - protein, 148 aa, Heterodera glycines
  Homolog annotation: Hit_ID=CAE59015.1; Match level="QueryCoverage =83%, HitCoverage=40%, E-value=6e-22, Identity=42%"; Hit description =Hypothetical protein CBG02292 [Caenorhabditis briggsae]
  Coding regions on vcDNA: vcDNA=SeqID_97329; Strand=+; Position=1-444
DRIKEWIYPMDVGPMIEELDKLAYFCRSQEKDSVMNHLREMPVGHFALRLSGTRRRFLALSIRVERDEKNQKGIAHYLVLRNEHGFRIKGSKRYFQSLPMLITHHSVITDQLPCRLLLSDWRWTRGDANQRRRQSSGGSTLAVLRATE

SEQ ID NO: 170907 - protein, 127 aa, Heterodera glycines
  Coding regions on vcDNA: vcDNA=SeqID_97330; Strand=+; Position=1-381
PKEAVEEEHGEEEGHNNIHFMYSITLDHYRTRPLVTVSTHSVQKPSFVSFFPFQCRPLFLIRSFASISLPKHKSRHNPSHPNSFLFLFPLIFSLIPLPPLNALTNPKDFQILFHSNFKFANNKCITI

SEQ ID NO: 170908 - protein, 110 aa, Heterodera glycines
  Homolog annotation: Hit_ID=NP_505492.1; Match level="QueryCoverage =73%, HitCoverage=18%, E-value=6e-24, Identity=61%"; Hit description =putative nuclear protein (55.4 kD) (5K149) [Caenorhabditis elegans] emb|CAA94805.1| Hypothetical protein
  Coding regions on vcDNA: vcDNA=SeqID_97331; Strand=+; Position=65-394
MRTFLFIAVVGLMLAVILENVNATGKNSPTKGKQSLDSPNHEKDHKNEHEKYEAAYIYRGDFFHDSKNEPHVEEQLVAAIYDLISKYKVDLYEIVIFVSKSPCFHQDCEP

SEQ ID NO: 170909 - protein, 100 aa, Heterodera glycines
  Coding regions on vcDNA: vcDNA=SeqID_97332; Strand=-; Position=1-300
EWVICAPAAILRRSGHFSGPFSGVEPLSSVTRHHHGSQIHYHRKLIRQTLERHVAGTRPCDQLSCSESTLDARRALGFVANKCAPLWGDWSFGACISSRI

SEQ ID NO: 170910 - protein, 75 aa, Heterodera glycines; identical to SEQ ID NO: 167783
  Coding regions on vcDNA: vcDNA=SeqID_97333; Strand=+; Position=1-228

SEQ ID NO: 170911 - protein, 128 aa, Heterodera glycines
  Homolog annotation: Hit_ID=NP_496492.1; Match level="QueryCoverage =92%, HitCoverage=12%, E-value=3e-17, Identity=46%"; Hit description =Dyggve-Melchior-Clausen syndrome protein like, possibly N -myristoylated (78.2 kD) (2L967) [Caenorhabditis
  Coding regions on vcDNA: vcDNA=SeqID_97334; Strand=+; Position=131-514
MSHLLNNWKVLLHNNVGFRNFVLSRINLEQLVLPVVRVLYDGMCSVPGHGFQRPSPTSSPKMRRQSQFSHNNSTVHTHQTYLALIVLLILSEDDFFKKVIHEMTIKNIDWYTLDRTTHLAETTLGGLI

SEQ ID NO: 170912 - protein, 59 aa, Heterodera glycines; identical to SEQ ID NO: 164110
  Coding regions on vcDNA: vcDNA=SeqID_97335; Strand=-; Position=10-189

SEQ ID NO: 170913 - protein, 131 aa, Heterodera glycines
  Coding regions on vcDNA: vcDNA=SeqID_97336; Strand=+; Position=2-394
LNEWLQKKGVPSDEAAFFLETYFHENEKQILNNFGRAFIACHETYGTNFTGKLAQIGITEKKLVQICQFLGYDDKIFDIQPIDSDVNFGLPDWKEFCPKLMANKIPKNSVVVMDKLNSVETVGMNKGQNIL

SEQ ID NO: 170914 - protein, 124 aa, Heterodera glycines
  Homolog annotation: Hit_ID=YP_054227.1; Match level="QueryCoverage =92%, HitCoverage=95%, E-value=3e-31, Identity=52%"; Hit description =hypothetical protein PTMB.298c [Paramecium tetraurelia] emb|CAH03496.1| hypothetical protein [Paramecium
  Coding regions on vcDNA: vcDNA=SeqID_97337; Strand=+; Position=21-392
MNVKGGGISQVNDSTSDEMRLFRGGLRHAGQTPSRLIYDTTSCIRNYHDKYSYERGFIAHSRSPSNQYLNFHFMYGGFKKFALERHVYQNWYRKNIRNWWLPAIICYTAGCLTMRMYDNAAYDY

SEQ ID NO: 170915 - protein, 26 aa, Heterodera glycines
  Coding regions on vcDNA: vcDNA=SeqID_97338; Strand=+; Position=77-157
LSTLARLPGLTGRKVGMTSNHHAPYV

SEQ ID NO: 170916 - protein, 67 aa, Heterodera glycines
  Coding regions on vcDNA: vcDNA=SeqID_97339; Strand=-; Position=0-200
LFFYKIYGGKNYSSASSALIVLRSCNTIANFSNALQFSSRNSLAFSVASSMVSRTALSRALFSLFLP

SEQ ID NO: 170917 - protein, 36 aa, Heterodera glycines
  Coding regions on vcDNA: vcDNA=SeqID_97340; Strand=-; Position=2-112
SLLQNDFSHNVINHYQIFKVSSIFSASISFFKLFSE

SEQ ID NO: 170918 - protein, 46 aa, Heterodera glycines; identical to SEQ ID NO: 167772
  Coding regions on vcDNA: vcDNA=SeqID_97341; Strand=+; Position=103-243

SEQ ID NO: 170919 - protein, 77 aa, Heterodera glycines; identical to SEQ ID NO: 164075
  Coding regions on vcDNA: vcDNA=SeqID_97342; Strand=+; Position=50-283

SEQ ID NO: 170920 - protein, 103 aa, Heterodera glycines
  Homolog annotation: Hit_ID=NP_912975.1; Match level="QueryCoverage =85%, HitCoverage=9%, E-value=6e-11, Identity=36%"; Hit description =unnamed protein product [Oryza sativa (japonica cultivar-group)] dbj|BAA88176.1| putative zwille protein [
  Coding regions on vcDNA: vcDNA=SeqID_97343; Strand=+; Position=83-391
MLSYKMSWILDKVKKNRSKPPSTIFIIRDGVSEGMVPNNIHDEFPSYVRACKKYDPTWEPKFVYCIVDKNHNKRFFVKGQQQVENTAPGAVIDSKVVRVDIHE

SEQ ID NO: 170921 - protein, 161 aa, Heterodera glycines
  Homolog annotation: Hit_ID=CAE62330.1; Match level="QueryCoverage =97%, HitCoverage=18%, E-value=7e-16, Identity=31%"; Hit description =Hypothetical protein CBG06401 [Caenorhabditis briggsae]
  Gene Ontology: Mol. function=translation initiation factor activity; Cellular component=eukaryotic 48S initiation complex; Biological process=regulation of translational initiation
  Coding regions on vcDNA: vcDNA=SeqID_97344; Strand=+; Position=2-484
HTEDPLIVGICANSLKNPYKFCGDYYFQPCTQDVLEPNMLSYKMSWILDKVKKNRSKPPSTIFIIRDGVSEGMVPNNIHDEFPSYVKACKKYDPNWEPKFVYCIVDKNHNKRFFVKGQQQVENTAPGAVIDSKVVRVDIHEFWMQSHVPLKGTSKMPQYIF

SEQ ID NO: 170922 - protein, 81 aa, Heterodera glycines; identical to SEQ ID NO: 167764
  Coding regions on vcDNA: vcDNA=SeqID_97345; Strand=+; Position=3-248

SEQ ID NO: 170923 - protein, 70 aa, Heterodera glycines; identical to SEQ ID NO: 167763
  Coding regions on vcDNA: vcDNA=SeqID_97346; Strand=-; Position=1-210

SEQ ID NO: 170924 - protein, 76 aa, Heterodera glycines
  Coding regions on vcDNA: vcDNA=SeqID_97347; Strand=-; Position=167-397
LVLLTIPKHSLCHLFGVLQSLLLCRRGRRRDWYDHLHVSDGEKAGPAVHCALKPMLVNLRIELNDLALLKVEFARV

SEQ ID NO: 170925 - protein, 45 aa, Heterodera glycines; identical to SEQ ID NO: 135550
  Coding regions on vcDNA: vcDNA=SeqID_97348; Strand=+; Position=3-140

SEQ ID NO: 170926 - protein, 26 aa, Heterodera glycines
  Coding regions on vcDNA: vcDNA=SeqID_97349; Strand=-; Position=1-78
MFKKLRLSRRLIIHTFLRFSFNRFHF

SEQ ID NO: 170927 - protein, 159 aa, Heterodera glycines
  Homolog annotation: Hit_ID=CAE70079.1; Match level="QueryCoverage =76%, HitCoverage=20%, E-value=1e-10, Identity=33%"; Hit description =Hypothetical protein CBG16520 [Caenorhabditis briggsae]
  Coding regions on vcDNA: vcDNA=SeqID_97350; Strand=+; Position=3-479
PVELSRDSPPNSTETIFVIKGTPFQIHHVQHIIRIKVGDVAPGTPLPSFHGNAGITNATTPLAVGNPYGPTPHQAFSAAPAQQDPSAWTQYYNQQQAMAIAGGPPSQPASFGATPAQHYQTVPGTMQTAVSQAAQLHSTQMQQQQIHQQQQATIAQPQQ

SEQ ID NO: 170928 - protein, 104 aa, Heterodera glycines; identical to SEQ ID NO: 158774
  Homolog annotation: Hit_ID=AAO92290.1; Match level="QueryCoverage =100%, HitCoverage=100%, E-value=2e-52, Identity=100%"; Hit description=FMRFamide-related peptide precursor [Heterodera glycines]
  Coding regions on vcDNA: vcDNA=SeqID_97351; Strand=+; Position=63-377

SEQ ID NO: 170929 - protein, 87 aa, Heterodera glycines
  Coding regions on vcDNA: vcDNA=SeqID_97352; Strand=+; Position=91-351
FPSNFPPSFCCCFCSLCCTFLHRPMLVPNGITPTQFRWPTIVALFSTICGDGSDLALKKTNKTIVNLCIILCKVLFNFVLINAINSK

SEQ ID NO: 170930 - protein, 90 aa, Heterodera glycines
  Homolog annotation: Hit_ID=NP_496710.1; Match level="QueryCoverage =98%, HitCoverage=4%, E-value=7e-35, Identity=79%"; Hit description =u5 small nuclear ribonucleoprotein helicase (2N18) [Caenorhabditis elegans] emb|CAB60351.1| Hypothetical p
  Gene Ontology: Mol. function=ATP dependent RNA helicase activity; Cellular component=spliceosome complex; Biological process=RNA splicing
  Coding regions on vcDNA: vcDNA=SeqID_97353; Strand=+; Position=1-270
SPQVKVNLLLHAHLMRIQLSAELTKDTDWIVLKTVRLVQACVDVLSSNGWLSPAIHAMELSQMLTQAMYSNESYMKQLPHCTPELLERCK

SEQ ID NO: 170931 - protein, 33 aa, Heterodera glycines
  Coding regions on vcDNA: vcDNA=SeqID_97354; Strand=+; Position=3-104
RRIPQKTHYFTNNINEKMNLFKLCFHFILYTDC

SEQ ID NO: 170932 - protein, 138 aa, Heterodera glycines
  Homolog annotation: Hit_ID=NP_492906.1; Match level="QueryCoverage =59%, HitCoverage=16%, E-value=1e-10, Identity=40%"; Hit description =Cyclin-Dependent Kinase (cdk-9) [Caenorhabditis elegans] emb|CAB07238.2| Hypothetical protein H25P06.2b [
  Coding regions on vcDNA: vcDNA=SeqID_97355; Strand=+; Position=48-461
NNSSHLFAPTHCQNNEQALSLIDFMLTLNPEKRPSASAALDHNFFFETPIPAINIQELLQQLRGTNLFEYTSGCGAHANRRRPVAPAAPMHQQQIRGKMPSVGGAMHRATGGAPQRAQHQTVGGPPNIHRSTGGAPQR

SEQ ID NO: 170933 - protein, 17 aa, Heterodera glycines
  Coding regions on vcDNA: vcDNA=SeqID_97356; Strand=+; Position=33-86
WKSIHSISSCCCCCCHP

SEQ ID NO: 170934 - protein, 78 aa, Heterodera glycines
  Coding regions on vcDNA: vcDNA=SeqID_97357; Strand=+; Position=86-322
MPSKRITVPLFLLLTVLVLALRASETKIKAMEEKVMEEQDKKMSKVFTFLSFQQLLTWLFPKCLLLIFYQCKHSSFIK

SEQ ID NO: 170935 - protein, 41 aa, Heterodera glycines
  misc_feature (13)..(13): Xaa can be any naturally occurring amino acid
  misc_feature (17)..(17): Xaa can be any naturally occurring amino acid
  Coding regions on vcDNA: vcDNA=SeqID_97358; Strand=-; Position=1-126
RSETHWRVEEEEXVARXFFPTFCLKSSFALRVGNLRACCHP

SEQ ID NO: 170936 - protein, 73 aa, Heterodera glycines
  Coding regions on vcDNA: vcDNA=SeqID_97359; Strand=+; Position=3-224
MEKEYKQSVRKLYAGKHRGYLLMPVELPNPNDPNGDRFSGQGHVLMEDLVWQLRGKTRNATHGIIMFYVIRNL

SEQ ID NO: 170937 - protein, 80 aa, Heterodera glycines; identical to SEQ ID NO: 167732
  Coding regions on vcDNA: vcDNA=SeqID_97360; Strand=+; Position=44-286

SEQ ID NO: 170938 - protein, 112 aa, Heterodera glycines
  Coding regions on vcDNA: vcDNA=SeqID_97361; Strand=-; Position=36-374
ILLNGQPMDKSEYIIYSFENGELGANEINIIIVHYYFINWLAPLTVHLLPNTHPPPKPAPRAPIELPNQSNWRFIRSGAKTPAEQRDTDRSRRRRSKTEGRRSERRKGIVFN

SEQ ID NO: 170939 - protein, 158 aa, Heterodera glycines
  misc_feature (135)..(135): Xaa can be any naturally occurring amino acid
  Coding regions on vcDNA: vcDNA=SeqID_97362; Strand=+; Position=83-556
YLSKSNTYYLKIYAFLNSKMGQKESRHAFVNCALIRREEFEDKIQELNKKCAECFEESTLNMLFATKSTEERGILWQRSVRIHCFTVFDEKIYRKVYSLFQFLKFYESFIQILEASEASKHRENSLNNKDLMSMXIFKESCCEYSEDGRCIICFDSFP

SEQ ID NO: 170940 - protein, 50 aa, Heterodera glycines
  Homolog annotation: Hit_ID=ZP_00357698.1; Match level="QueryCoverage =100%, HitCoverage=28%, E-value=3e-14, Identity=82%"; Hit description= hypothetical protein Chlo02002738 [Chloroflexus aurantiacus]
  Coding regions on vcDNA: vcDNA=SeqID_97363; Strand=-; Position=1-150
FFFFFFFFFFFFFFFFFFFFFFFFFFFFFFFNFRKIYATKNEKYNNNQIY

SEQ ID NO: 170941 - protein, 65 aa, Heterodera glycines
  Coding regions on vcDNA: vcDNA=SeqID_97364; Strand=+; Position=2-199
CTEFGQKTCNSPPPPLTFISFSTALFILFYLSPPSLNAIPSFSFFSLFSHFRRFVSFTAHSFIVS

SEQ ID NO: 170942 - protein, 98 aa, Heterodera glycines; identical to SEQ ID NO: 164065
  Coding regions on vcDNA: vcDNA=SeqID_97365; Strand=-; Position=3-296

SEQ ID NO: 170943 - protein, 123 aa, Heterodera glycines
  Homolog annotation: Hit_ID=CAC12959.1; Match level="QueryCoverage =90%, HitCoverage=30%, E-value=1e-12, Identity=36%"; Hit description =beta-1,4-endoglucanase 2 precursor [Heterodera schachtii]
  Coding regions on vcDNA: vcDNA=SeqID_97366; Strand=+; Position=1-372
QNMLKKAIKSGLPVFVTESGAGSGGSNAPVNLPVMNQWWSLLEQLKISQIVWAVRGEGNLQNPLNKNTAPANIGQNWALTEYGKVVKNVFTKNAKPKRGRKGSGMREKKERKANEAEEKRNER

SEQ ID NO: 170944 - protein, 62 aa, Heterodera glycines
  Coding regions on vcDNA: vcDNA=SeqID_97367; Strand=+; Position=1-189
GQFNGRIFNNKLNNLGFPTFITFAQLMDPSRGFYDKDGDKVTLAVDVAVKSKRGTKRKLSDE

SEQ ID NO: 170945 - protein, 49 aa, Heterodera glycines
  Coding regions on vcDNA: vcDNA=SeqID_97368; Strand=-; Position=2-148
TFLYEFPAPQMIRQINDQQMDNDNDSRLGNDSYHRSVSPISQIGCNRLR

SEQ ID NO: 170946 - protein, 51 aa, Heterodera glycines
  misc_feature (1)..(1): Xaa can be any naturally occurring amino acid
  Coding regions on vcDNA: vcDNA=SeqID_97369; Strand=-; Position=2-154
XIKKFTVNSAGNTMTNLLVSDHNNPPGKCPPHSATTATRTELSYVVLFRSL

SEQ ID NO: 170947 - protein, 52 aa, Heterodera glycines
  Coding regions on vcDNA: vcDNA=SeqID_97370; Strand=-; Position=1-156
IFNFLKRKQNLDKGKRIEEMTERDSLFIQFLRTFTTANWSAENWAGNCRRRK

SEQ ID NO: 170948 - protein, 63 aa, Heterodera glycines
  Coding regions on vcDNA: vcDNA=SeqID_97371; Strand=+; Position=3-191
PITGIQAQQIYSAFFLWHKLLTFPHLPCLFQFSYDTTFLNIHFYNFFKLILIHSTVYHKRNFI

SEQ ID NO: 170949 - protein, 95 aa, Heterodera glycines
  Coding regions on vcDNA: vcDNA=SeqID_97372; Strand=+; Position=1-288
NFFISFLFNSKINPPVSQRRWYEQKKKDRSVLLEGWNSVLNECFLPLFNQKMNMAESADSKQFRQLRGLLFGRFSESGRCDVIVAQAKAFIRFYS

SEQ ID NO: 170950 - protein, 88 aa, Heterodera glycines
  misc_feature (1)..(1): Xaa can be any naturally occurring amino acid
  Coding regions on vcDNA: vcDNA=SeqID_97373; Strand=-; Position=0-263
XIFQLVLLLIMRTLKNKCGILQGHSLVLVFTLLFSPFGFLLPRVDCELSLFFFRRSPIAQLPSLFLLHSVLPWPIPFVSIFPVVLQSL

SEQ ID NO: 170951 - protein, 59 aa, Heterodera glycines; identical to SEQ ID NO: 164110
  Coding regions on vcDNA: vcDNA=SeqID_97374; Strand=-; Position=8-187

SEQ ID NO: 170952 - protein, 172 aa, Heterodera glycines
  Homolog annotation: Hit_ID=NP_033882.1; Match level="QueryCoverage =99%, HitCoverage=26%, E-value=7e-53, Identity=55%"; Hit description =galactosidase, beta 1 [Mus musculus] pir||A37086 beta-galactosidase (EC 3.2.1.23) precursor - mouse gb|AA
  Gene Ontology: Mol. function=beta-galactosidase activity; Cellular component=extracellular space
  Coding regions on vcDNA: vcDNA=SeqID_97375; Strand=+; Position=2-517
AAGLNAVQLYIPWNFHEQEIGRFNFGGDRNISRFIRIAKQNELYVLIRMGPYVCAELEFGGLPWWLIKDQAKVRLRSSETTYLRHVHRWLAALLSVLRPLLYKNGGPILMVQLEKEYGSVSVCDHDYMRWLRDFVRETLGEDVVLYTTDGPTEKMLSCGAIESTFATVDFGT

SEQ ID NO: 170953 - protein, 106 aa, Heterodera glycines; identical to SEQ ID NO: 164044
  Homolog annotation: Hit_ID=AAT92076.1; Match level="QueryCoverage =96%, HitCoverage=44%, E-value=6e-27, Identity=45%"; Hit description =Hypothetical protein F42H10.3 [Caenorhabditis elegans] sp|P34416|LAS1_CAEEL LIM and SH3 domain protein F42
  Gene Ontology: Mol. function=SH3/SH2 adaptor protein activity; Cellular component=sarcomere; Biological process=somatic muscle development
  Coding regions on vcDNA: vcDNA=SeqID_97376; Strand=+; Position=2-322

SEQ ID NO: 170954 - protein, 69 aa, Heterodera glycines
  Coding regions on vcDNA: vcDNA=SeqID_97377; Strand=-; Position=3-209
FLKIKPIYCSKWRQMFTYFVLISVSPIQHSDHFRPFIHSFVSSVGVRHFALNFFFGQNLGHFALAGDLF

SEQ ID NO: 170955 - protein, 150 aa, Heterodera glycines
  misc_feature (128)..(128): Xaa can be any naturally occurring amino acid
  Homolog annotation: Hit_ID=CAE59576.1; Match level="QueryCoverage =99%, HitCoverage=45%, E-value=8e-34, Identity=46%"; Hit description =Hypothetical protein CBG02976 [Caenorhabditis briggsae]
  Gene Ontology: Mol. function=protein phosphatase type 2C activity; Biological process=cell cycle
  Coding regions on vcDNA: vcDNA=SeqID_97378; Strand=+; Position=1-449
MRCALYALFDGHAGRRAADYCAEHFARLFVAVFKKYVPPKSAMSVFEKSIRKVFVDTYKGIDDGFLVEARRQKPTLKDGTTATTIFLLDKTLYCANIGDSKAIVCRHKSEKSTNIPLQITVDHNPLVXDERMRIQKSGGTVKDGRVFGIL

SEQ ID NO: 170956 - protein, 98 aa, Heterodera glycines; identical to SEQ ID NO: 143443
  Coding regions on vcDNA: vcDNA=SeqID_97379; Strand=+; Position=2-298

SEQ ID NO: 170957 - protein, 103 aa, Heterodera glycines
  Coding regions on vcDNA: vcDNA=SeqID_97380; Strand=-; Position=1-309
LLSTPFCCTFVEAKGALVDAIVCQRFSEMRIAPPPSSRHHLLNYSFNVLISFDISICSPKDRTVFASFATSLFKVFVGILARKGADLLLFVVVKRKSISYDGP

SEQ ID NO: 170958 - protein, 48 aa, Heterodera glycines
  misc_feature (24)..(24): Xaa can be any naturally occurring amino acid
  Homolog annotation: Hit_ID=ZP_00357698.1; Match level="QueryCoverage =66%, HitCoverage=17%, E-value=6e-10, Identity=83%"; Hit description =hypothetical protein Chlo02002738 [Chloroflexus aurantiacus]
  Coding regions on vcDNA: vcDNA=SeqID_97381; Strand=-; Position=5-148
FFFFFFFFFFFFFFFFFFFFFFFXVVKYFFFTNKKYRNLCGKFEVFGM

SEQ ID NO: 170959 - protein, 152 aa, Heterodera glycines
  Homolog annotation: Hit_ID=AAP30835.1; Match level="QueryCoverage =88%, HitCoverage=100%, E-value=1e-75, Identity=75%"; Hit description= putative gland protein G33E05; Hg-G33E05 [Heterodera glycines]
  Coding regions on vcDNA: vcDNA=SeqID_97382; Strand=+; Position=66-521
MRTFLFIAVVGLVLAVIMESVNATGNNSPTKGQTPPGSPKGGHGSNKSPTTPHSAGSPHGTQHGNQQNHATGQTPPGSPKGGHGNNKSPTTPHSAGSPHGTQHGNQQKNATGQTPPGSPKGGHGNNKSPTTPHSTKRETELIIEKGKPSPDS

SEQ ID NO: 170960 - protein, 56 aa, Heterodera glycines
  Homolog annotation: Hit_ID=ZP_00357698.1; Match level="QueryCoverage =85%, HitCoverage=27%, E-value=2e-17, Identity=78%"; Hit description =hypothetical protein Chlo02002738 [Chloroflexus aurantiacus]
  Coding regions on vcDNA: vcDNA=SeqID_97383; Strand=-; Position=10-180
TGGKTPGAFFFFFFFFFFFFFFFFFFFFSFFFFFFFFFFFFFFFFFIAFYQQKFQH

SEQ ID NO: 170961 - protein, 67 aa, Heterodera glycines
  Coding regions on vcDNA: vcDNA=SeqID_97384; Strand=+; Position=2-202
DNRRDERTVQSRQRAAYDRLMCMFATQQRPDSCGFFEKEWKNEWNCEKSSPKCLMPAQINVNKAFNF

SEQ ID NO: 170962 - protein, 88 aa, Heterodera glycines; identical to SEQ ID NO: 164036
  Homolog annotation: Hit_ID=AAH73580.1; Match level="QueryCoverage =92%, HitCoverage=95%, E-value=8e-24, Identity=64%"; Hit description =MGC82877 protein [Xenopus laevis]
  Coding regions on vcDNA: vcDNA=SeqID_97385; Strand=+; Position=89-355

SEQ ID NO: 170963 - protein, 73 aa, Heterodera glycines
  Homolog annotation: Hit_ID=NP_491412.1; Match level="QueryCoverage =97%, HitCoverage=82%, E-value=5e-23, Identity=70%"; Hit description =Acyl-coA-binding protein, ACBP (9.4 kD) (1F204) [Caenorhabditis elegans] gb|AAB54171.1| Hypothetical prot
  Coding regions on vcDNA: vcDNA=SeqID_97386; Strand=+; Position=2-223
EAKTLSYQPSNDELLELYALFKQGTVGDNDTPRPGMFDIKGKAKWDAWTAKKGTTKEDAQQKYIDLVEALLFK

SEQ ID NO: 170964 - protein, 33 aa, Heterodera glycines
  Coding regions on vcDNA: vcDNA=SeqID_97387; Strand=+; Position=1-102
ISRTHCQLDEMKFNCMLSLCFQKLTFKLMSIVL

SEQ ID NO: 170965 - protein, 81 aa, Heterodera glycines; identical to SEQ ID NO: 167673
  Coding regions on vcDNA: vcDNA=SeqID_97388; Strand=+; Position=81-326

SEQ ID NO: 170966 - protein, 65 aa, Heterodera glycines
  Coding regions on vcDNA: vcDNA=SeqID_97389; Strand=+; Position=2-196
HEIVFTAQMPHMRDGVQLEYSPLYQFLIGFLDLEFEFRPETTSFSEDILMEFDVRMAFWRRGGPP

SEQ ID NO: 170967 - protein, 199 aa, Heterodera glycines
  misc_feature (144)..(144): Xaa can be any naturally occurring amino acid
  Homolog annotation: Hit_ID=CAE58603.1; Match level="QueryCoverage =98%, HitCoverage=51%, E-value=7e-54, Identity=52%"; Hit description =Hypothetical protein CBG01770 [Caenorhabditis briggsae]
  Gene Ontology: Mol. function=kinase activity; Cellular component =plasma membrane; Biological process=zygotic determination of dorsal/ventral axis
  Coding regions on vcDNA: vcDNA=SeqID_97390; Strand=+; Position=253-848
MPATNSPQSSNLAEKATDSLLNGLQNTPAVTYEDLTVATDGFSPNKIVGRGGYGVVYRGVWKHTPVAIKRIQGKCGSDERQQRERIRQSLQELKTLAKFRHDNVLSLYGYSLDGPEPCLVYQFMSNGTLEDRLLCRVTYNGNHXNGTEPLGWAKKLSICGGVCRGLHFLHTINQMPIIHGDVKSANILLDKHFEPKLGD

SEQ ID NO: 170968 - protein, 255 aa, Heterodera glycines
  Homolog annotation: Hit_ID=NP_490660.1; Match level="QueryCoverage =90%, HitCoverage=94%, E-value=7e-53, Identity=46%"; Hit description =AD-003 protein (26.6 kD) (1A478) [Caenorhabditis elegans] gb|AAF36050.2| Hypothetical protein Y74C9A.3 [C
  Coding regions on vcDNA: vcDNA=SeqID_97391; Strand=+; Position=38-805
MDSLLLATNDHSNGETAATLEEIYRKALEYWNSVGSDLNGMLGGFQQLHRPDINDSINFLCELRKKSFLRHFDRALDCGCGIGRVTKHLLLPAFRSVDMVDFSDHLIAQSHIFVPSSSNPTENNSVGQRFVESLHTFAPAEKGGDYDMIWIQWVTGQLEDNHLVDFLRRCKESVLRRDGCIVVKDNVAKGTEKEFDEVDNSWARPREMLHKLFERADCRIVLERKQPNIPKALYEVRTFALKPLSNDETNGMNDD

SEQ ID NO: 170969 - protein, 210 aa, Heterodera glycines
  Homolog annotation: Hit_ID=NP_509222.2; Match level="QueryCoverage =83%, HitCoverage=41%, E-value=2e-26, Identity=39%"; Hit description =putative protein family member (49.4 kD) (XH885) [Caenorhabditis elegans] gb|AAB37021.2| Hypothetical pro
  Coding regions on vcDNA: vcDNA=SeqID_97392; Strand=+; Position=58-690
AAISESPLNNCPVKVLPSFTSTFLPDLSNAQVLKPKPTNVDRLPLSNEEFITPTQPKKQQSRPNSPANGVSKLILPRSRVASIRRESDCNSEKGFGEAEAAHEKMVKSAQQVAMGFEDFCLDDKAFEERKRAKSLSEPICIFTNAFLPQCSSPSPSRGSMDGQKQCYSPSAQQVVRSNLAYSPSPSPTPSGTQSMHRMRSCESQTHLPDD

SEQ ID NO: 170970 - protein, 131 aa, Heterodera glycines; identical to SEQ ID NO: 167665
  Coding regions on vcDNA: vcDNA=SeqID_97393; Strand=+; Position=3-398

SEQ ID NO: 170971 - protein, 159 aa, Heterodera glycines
  Homolog annotation: Hit_ID=EAA10890.2; Match level="QueryCoverage =88%, HitCoverage=68%, E-value=6e-31, Identity=48%"; Hit description =ENSANGP00000017070 [Anopheles gambiae str. PEST]
  Gene Ontology: Mol. function=RNA binding
  Coding regions on vcDNA: vcDNA=SeqID_97394; Strand=+; Position=4-480
LPLQEEPISGGQPNTPPIPAIELSYPVSVIYCGECSMPVEYCEYSGKFERCQQWLERNLPDLAEKQMKIGAGDGKAAEEGNGEETEAKKHQKRGGKGLPKASGGGKGSKEQSAAVPRITLKTEVRSKNKAVTVVKGLTTCGVDLKTASKFFANRFACGC

SEQ ID NO: 170972 - protein, 95 aa, Heterodera glycines; identical to SEQ ID NO: 167658
  Coding regions on vcDNA: vcDNA=SeqID_97395; Strand=+; Position=27-314

SEQ ID NO: 170973 - protein, 155 aa, Heterodera glycines
  Homolog annotation: Hit_ID=NP_506179.1; Match level="QueryCoverage =83%, HitCoverage=56%, E-value=1e-24, Identity=42%"; Hit description =mitochondrial ribosomal protein L49 (5N209) [Caenorhabditis elegans] emb|CAA99906.1| Hypothetical protein
  Coding regions on vcDNA: vcDNA=SeqID_97396; Strand=+; Position=84-548
MFSFCYRRAIRKSLANPQTIEVSSFHFSRVLEQNLDAASKRDEKGEEVPLWKDPYKHAMPEQKNTFSEFREANVHWEYVRRLLPRRLIPEIPQNAAEGVTPSGWRAPPEKAPNLPYYIRRKANHLPSIFLERRRDELNPKTMDFEYVELVILTGI

SEQ ID NO: 170974 - protein, 100 aa, Heterodera glycines
  Coding regions on vcDNA: vcDNA=SeqID_97397; Strand=-; Position=5-307
LFINANYKFKCPFASAQFSRFVQSLASRSVAKINSESNDRFSLFPLEVLSAKSQVVAGIQYQLRIKVGRSNCSKNVSERANSATHVLEFPSNNKYFYFFY

SEQ ID NO: 170975 - protein, 73 aa, Heterodera glycines
  Coding regions on vcDNA: vcDNA=SeqID_97398; Strand=+; Position=1-222
PPCPPGEPGKCYGSGSKESKEKEYKPSKRSIDNFEHGLRVARGYKQEVGPPGPAGPPGPPGPDGPPGECECKY

SEQ ID NO: 170976 - protein, 209 aa, Heterodera glycines
  Homolog annotation: Hit_ID=AAT02161.1; Match level="QueryCoverage =93%, HitCoverage=92%, E-value=5e-40, Identity=44%"; Hit description =hypothetical protein L3ni22 [Dictyocaulus viviparus]
  Coding regions on vcDNA: vcDNA=SeqID_97399; Strand=+; Position=1-630
HLRALIPTYVLLFSHFYLLLVLAKGFEGYTFSCLDGCECDTDDEAIHCHNRPDRHFVQLPPSRLRGFTVLALTRNNIDVLPSEEVLLEKLPDLKAVDVEGNEHFDCSTLDHYRILMVMSDCGKTPEQLEADRAKLPTDTQPNEDCDFECVANRRSRELREYVKHLWEMVKEKVSRLAKKHGLDKVVDDVGNFFNDVGERISNIKLKKKK

SEQ ID NO: 170977 - protein, 60 aa, Heterodera glycines; identical to SEQ ID NO: 167644
  Coding regions on vcDNA: vcDNA=SeqID_97400; Strand=-; Position=66-248

SEQ ID NO: 170978 - protein, 256 aa, Heterodera glycines
  Coding regions on vcDNA: vcDNA=SeqID_97401; Strand=+; Position=73-840
PLRPGDFCTSAISERLANSLLAYEMDADSFLLFYIKQRIERGEDGLQWYNPPYCGEDEEGHVPDNWRTIQQAVLYFEKDNSDEIEHQLIDQLVQHSAVKFSAFKYLVDAYFGLLQRRIERKADNFGCPSVTNLCVPFLAMIAFTGLFARRLAEMDASARVTEEEQQDRRDFRREIYQVSIYGSTMLRYKLYTFANNEDSTAAYSWDRFCADSLQLVEHISSLKERETSIALPSASPLLGVVLCGIAAAAVVYFLIA

SEQ ID NO: 170979 - protein, 87 aa, Heterodera glycines
  Coding regions on vcDNA: vcDNA=SeqID_97402; Strand=-; Position=4-267
MNFYKSTTFIGLFFIILANSFFDHADDPKLASSFLCCAIVFHFSGQNFPFRHGSVNGHRTAGSFLCECTWGNLLGNGEKSNGQKKAS

SEQ ID NO: 170980 - protein, 28 aa, Heterodera glycines
  Coding regions on vcDNA: vcDNA=SeqID_97403; Strand=+; Position=3-89
FVQFLRFSILSTLSTYRASVCRAPLISQ

SEQ ID NO: 170981 - protein, 110 aa, Heterodera glycines; identical to SEQ ID NO: 167635
  Coding regions on vcDNA: vcDNA=SeqID_97404; Strand=+; Position=10-342

SEQ ID NO: 170982 - protein, 275 aa, Heterodera glycines
  Homolog annotation: Hit_ID=NP_498711.1; Match level="QueryCoverage =98%, HitCoverage=43%, E-value=2e-72, Identity=51%"; Hit description =tyrosinase and metridin-like ShK toxin family member (68.4 kD) (3I965) [Caenorhabditis elegans] gb|AAA279
  Coding regions on vcDNA: vcDNA=SeqID_97405; Strand=+; Position=1-825
MPSAHGGPTFLLWHREYLKRMEIALRAIDPSVAIPFWDSAMDQRLPNPADSVIWSSSFMGALSAAGTVADGPVAGWITPSGGPIRRSLGTRGGNLLTEQEVASLIGQPQIENVLAFTSRARSGACTQPTPNPLSVLEFIHNGVHAWVGGDMLPLTTSPQDPVFFLHHSFIDYIWEQWRLLHQNRQQRETQFPPDSQIVPCAGSQNYLLSATMFPFQDPVVLNRAGLSNSYTDSLYTYAPRPTCRAAGDCRSRYLFCDTTSGRPLCTSRIKPGGNC

SEQ ID NO: 170983 - protein, 155 aa, Heterodera glycines
  Homolog annotation: Hit_ID=CAE68921.1; Match level="QueryCoverage =99%, HitCoverage=45%, E-value=3e-27, Identity=42%"; Hit description =Hypothetical protein CBG14900 [Caenorhabditis briggsae]
  Coding regions on vcDNA: vcDNA=SeqID_97406; Strand=+; Position=1-465
RHLLLKSPLLVLCFVVPSSFSDPCPFFGDYQCPEGFHCAFDKCQDEQGMEPPGDCAKIRCGKESECRQGKCVLYVGRPCGRNVLVAEGLARAVVSDCGPQGKCIGGRCAIDRCADTVCEEMSELCRDGMCMQLSSMFCFSPFDCGPPSLFECHQN

SEQ ID NO: 170984 - protein, 276 aa, Heterodera glycines
  Homolog annotation: Hit_ID=CAE59495.1; Match level="QueryCoverage =90%, HitCoverage=69%, E-value=5e-56, Identity=42%"; Hit description =Hypothetical protein CBG02880 [Caenorhabditis briggsae]
  Gene Ontology: Mol. function=protein tyrosine kinase activity; Cellular component=kinetochore microtubule; Biological process =protein amino acid phosphorylation
  Coding regions on vcDNA: vcDNA=SeqID_97407; Strand=+; Position=108-935
MLQAHQYQLQQGHRRVSARSILAHFGFEFSNDYRLGCGHYSKVYKGYFKEAQRTFAIKVTDLESVSEKFKQKFLPRELEVWRELDHPNLVYLYNDFQWSDYQFVVMELAVGGDLLSFLQKCGPVSETTCHNWMLQIVAALDYLHRKGIAHRDLKLKHVLLCENGVIKVTDYGFSKQSSDLSSTFCGSRSYSSPEILLGIAYDMFKSDIWSLGVTAFIMITNTMPFHEDLPNQQIVDSQRKRRYKYPSWLNITKQCRTAIDALLTYQPAFRPNISEC

SEQ ID NO: 170985 - protein, 96 aa, Heterodera glycines; identical to SEQ ID NO: 167628
  Coding regions on vcDNA: vcDNA=SeqID_97408; Strand=+; Position=22-312

SEQ ID NO: 170986 - protein, 57 aa, Heterodera glycines
  Coding regions on vcDNA: vcDNA=SeqID_97409; Strand=+; Position=10-183
RNSFVFVLSFHLHRRTDWKMITDMQLGIMANVLGVSIFILVIFYHYIVANQKKQSPQ

SEQ ID NO: 170987 - protein, 65 aa, Heterodera glycines; identical to SEQ ID NO: 167624
  Coding regions on vcDNA: vcDNA=SeqID_97410; Strand=-; Position=126-323

SEQ ID NO: 170988 - protein, 132 aa, Heterodera glycines
  Homolog annotation: Hit_ID=NP_497846.3; Match level="QueryCoverage =98%, HitCoverage=34%, E-value=1e-59, Identity=83%"; Hit description =mitogen-activated Protein Kinase, plays a role in signal transduction during vulval development, involved
  Gene Ontology: Mol. function=MAP kinase activity; Cellular component =cytoplasm; Biological process=synaptic transmission
  Coding regions on vcDNA: vcDNA=SeqID_97411; Strand=+; Position=83-478
AVSVAEIANGVEEVHGQIFEVAPRYVNLSYIGEGAYGMVVSALDTVTRERVAIKKISPFEHQTFCQRTLREIKILSRFKHENIINIQAIIRAPSIELMKDIYIVQCLMETDLYKLLKTQRLSNDHICYFLYQ

SEQ ID NO: 170989 - protein, 121 aa, Heterodera glycines
  Coding regions on vcDNA: vcDNA=SeqID_97412; Strand=+; Position=3-368
QYTFVAMLPSNLFFLLMTMLSSSLLHQTLANKFSAETDAVNPTRLIQRRHLIRSRAIHKEKMHSNDFAEEFPISDGPQVFGIGGTAAFENIGGWDADKKRFGRGKVAELAAQAFPSCENNF

SEQ ID NO: 170990 - protein, 83 aa, Heterodera glycines
  Homolog annotation: Hit_ID=NP_495122.1; Match level="QueryCoverage =96%, HitCoverage=70%, E-value=5e-15, Identity=56%"; Hit description =rox8 like (2G2) [Caenorhabditis elegans] gb|AAK68193.1| Hypothetical protein C18A3.5c [Caenorhabditis ele
  Coding regions on vcDNA: vcDNA=SeqID_97413; Strand=+; Position=101-349
MAYANYGYGSYGYGGEDFSAGAYNPRYHYAAAQNAGFDLKTDDGLPRTIYVGNLDVSVTEDFIATLFGQIGPVTKTKVIFDSG

SEQ ID NO: 170991 - protein, 119 aa, Heterodera glycines; identical to SEQ ID NO: 167615
  Homolog annotation: Hit_ID=AAL62471.1; Match level="QueryCoverage =95%, HitCoverage=94%, E-value=1e-47, Identity=82%"; Hit description =ribosomal protein L34 [Spodoptera frugiperda]
  Gene Ontology: Mol. function=structural constituent of ribosome; Cellular component=cytosolic large ribosomal subunit (sensu Eukarya); Biological process=protein biosynthesis
  Coding regions on vcDNA: vcDNA=SeqID_97414; Strand=+; Position=12-371

SEQ ID NO: 170992 - protein, 64 aa, Heterodera glycines
  Homolog annotation: Hit_ID=CAA07704.1; Match level="QueryCoverage =64%, HitCoverage=34%, E-value=5e-17, Identity=100%"; Hit description= lacZ' [Cloning vector pGreen]
  Coding regions on vcDNA: vcDNA=SeqID_97415; Strand=+; Position=224-415
LGSDCKFENPEKKKKKKKKKKKNSRGGPVPNSPYSESYYNSLAVVLQRRDWENPGVTQLNRLAA

SEQ ID NO: 170993 - protein, 211 aa, Heterodera glycines
  Coding regions on vcDNA: vcDNA=SeqID_97416; Strand=+; Position=1-633
SGSPGCRNSARGSLIREQNRRMASQNGVLENQLEICQGLVNELRAEVDSLRGELSECKLPFRISNSELQNITVRHSRTGDAVERIGPRKANTKSLLKPRARLCSNTPKMAVPSEKRAKRGLTKDSEDDDNFRTAEFVPTTPRPQFLLPPLVLTPLSSRFPPLPRRSFSVEPTPTHIQKNAEQQLTMIRDGNGDMPCPSSQKRLNDNGEIQC

SEQ ID NO: 170994 - protein, 122 aa, Heterodera glycines
  Coding regions on vcDNA: vcDNA=SeqID_97417; Strand=-; Position=149-517
RFSAAVRPSVAGGARRSVRLLFALGVFHGGSQQRIALSAFFCRAQINAHSHILHQFALFAGGDQRILRRQPPGAALLSVGGWEVEKVAETAAQHRVNAVFPPVQSASLVHVVQQPPPYSNCP

SEQ ID NO: 170995 - protein, 211 aa, Heterodera glycines; identical to SEQ ID NO: 167613
  Coding regions on vcDNA: vcDNA=SeqID_97418; Strand=+; Position=1-636

SEQ ID NO: 170996 - protein, 238 aa, Heterodera glycines
  Homolog annotation: Hit_ID=NP_506367.1; Match level="QueryCoverage =86%, HitCoverage=90%, E-value=2e-30, Identity=35%"; Hit description =tubulin folding cofactor B (5O73) [Caenorhabditis elegans] emb|CAB01212.1| Hypothetical protein F53F4.3 [
  Gene Ontology: Mol. function=co-chaperone activity; Cellular component=microtubule; Biological process=alpha-tubulin folding
  Coding regions on vcDNA: vcDNA=SeqID_97419; Strand=+; Position=3-719
PNLSISTNKTEFPYLVRYPATMALVEFKVKLELVVGIYSADMKLELRSHEGKFISELIGDDRTLEELGVRDQCIVNVCDTSETRNDNSTNDPNAFYVIPEERYANRKDTARKWKQQLMTTATTTTDVERSEQQVPNKIGPGKRCIVQLRDQPPRKAQIAFVGPTHFGENPGTTQWVGVIYDEATGKNDGSLDGHRYFRSEPSHGGFVQIRAIVNVLDDVEQAANDKEQIQQQMEIEEI

SEQ ID NO: 170997 - protein, 126 aa, Heterodera glycines
  Homolog annotation: Hit_ID=NP_505798.1; Match level="QueryCoverage =95%, HitCoverage=24%, E-value=4e-30, Identity=56%"; Hit description =vacuolar protein sorting 36 (5L440) [Caenorhabditis elegans] emb|CAA96630.1| Hypothetical protein F17C11.
  Coding regions on vcDNA: vcDNA=SeqID_97420; Strand=+; Position=447-824
ISLPSKLNQKKSEKVVVSSVRMDRLSWYQTGESMEEILCQAGSVGIYDGDLKQTSFEQGTASLTYQRIIWADSTDPVGRETGFEFRPPKLKDCRLVLHHSMVHKIEKQHKTMFGRGGKIIVTVKPV

SEQ ID NO: 170998 - protein, 156 aa, Heterodera glycines
  misc_feature (114)..(114): Xaa can be any naturally occurring amino acid
  Homolog annotation: Hit_ID=C88618; Match level="QueryCoverage=87%, HitCoverage=17%, E-value=1e-35, Identity=52%"; Hit description =protein ZK520.4 [imported] - Caenorhabditis elegans
  Gene Ontology: Mol. function=protein binding; Cellular component=SCF ubiquitin ligase complex; Biological process=induction of apoptosis by intracellular signals
  Coding regions on vcDNA: vcDNA=SeqID_97421; Strand=+; Position=1-471
IKTPNNLHKLPSFAFLSVPAVIRASRSLVDISILTTEEKGEELTDKTMLHLNTEFTWKRQKFKVMLPLPSKPQEKEAEATCNTVQQDRKYYTECAIVRIMKSRKVMKHGALVEXVIKQSQLRFVPDVQFIKKNIESLIDKYYLQRTDQNDEYEYIS

SEQ ID NO: 170999 - protein, 139 aa, Heterodera glycines
  Homolog annotation: Hit_ID=BAB69973.1; Match level="QueryCoverage =76%, HitCoverage=19%, E-value=3e-10, Identity=38%"; Hit description =Myt1 [Asterina pectinifera]
  Coding regions on vcDNA: vcDNA=SeqID_97422; Strand=+; Position=112-528
MEMQASPGPDCGFTTPSRTSTNSKFIVDVPLSTKREKLLRGTPTRFRLPPVRRLMKSAPNIHHRFYLARDHIEPFAQIVSFKRSEDRPSLSNRYRPELEETYLQQCFVLQGRLGQGDFGEVVSVRSKDDGKLYAVKSSL

SEQ ID NO: 171000 - protein, 205 aa, Heterodera glycines
  Homolog annotation: Hit_ID=NP_871910.1; Match level="QueryCoverage =100%, HitCoverage=45%, E-value=3e-19, Identity=30%"; Hit description= abnormal OOCyte formation OOC-3, putative protein, with at least 2 transmembrane domains (50.7 kD) (ooc-
  Coding regions on vcDNA: vcDNA=SeqID_97423; Strand=+; Position=4-618
MRRYLDTEKAVEEFGLREDLRAALENFLVESDIRSDHSLFTFLHNLLPYIMLLNVILLIPAALFFLRSTVSTRKLVTFLLLSTFCWSCYATYMRKYQEILAERFLRTDAVFRRGGGVCSPQGLLSEAFDVMLSYVRIKQKSECLKAYEDELIAPLWQVDPLQVIAEVLSNFFLGGLPASGTHLNLFFNNFFVDTPFHLALVKMLF

SEQ ID NO: 171001 - protein, 173 aa, Heterodera glycines
  Homolog annotation: Hit_ID=AAG21339.1; Match level="QueryCoverage =83%, HitCoverage=78%, E-value=4e-18, Identity=47%"; Hit description =hypothetical esophageal gland cell secretory protein 10 [Heterodera glycines]
  Gene Ontology: Cellular component=secretory vesicle
  Coding regions on vcDNA: vcDNA=SeqID_97424; Strand=+; Position=7-525
WIPGLQEFGTRARSSTETPGPPGPSTVTPGPESSTSTPSEGPGTPSTETPGPSTEAPGPPGPSTETPGPSGPSTETPGPSGPSTETPGPPGPSTAGTSSTKTYTVPTTPKPPPCCYGCDYPVDCHTSGKDCDYSPLQPPYQSDPYPVGKCVFKNVTCAAPNTGKVLFMKLNND

SEQ ID NO: 171002 - protein, 96 aa, Heterodera glycines; identical to SEQ ID NO: 162270
  Coding regions on vcDNA: vcDNA=SeqID_97425; Strand=-; Position=2-289

SEQ ID NO: 171003 - protein, 149 aa, Heterodera glycines
  Homolog annotation: Hit_ID=AAH80142.1; Match level="QueryCoverage =82%, HitCoverage=30%, E-value=5e-34, Identity=53%"; Hit description =MGC89709 protein [Xenopus tropicalis] ref|NP_001007877.1| MGC89709 protein [Xenopus tropicalis]
  Coding regions on vcDNA: vcDNA=SeqID_97426; Strand=+; Position=44-490
NPKGKSVADYSGSNGFVPANGGGAVQKNRPDRRQILFWRSPFRTLLYFVLELVHIVWDFGGRLFVLRFLLPFLLAFGSLLFLFFVPGAHSSYVRHFEKKLLWCFYWLGLGVLSSIGLGTGLHTFLLYLGPHIARVTLAAFECNSLDFPE

SEQ ID NO: 171004 - protein, 174 aa, Heterodera glycines
  Homolog annotation: Hit_ID=NP_501594.1; Match level="QueryCoverage =61%, HitCoverage=48%, E-value=9e-10, Identity=31%"; Hit description =RNA and export factor binding protein, ALY family (aly-2) [Caenorhabditis elegans] emb|CAB05180.1| Hypoth
  Coding regions on vcDNA: vcDNA=SeqID_97427; Strand=+; Position=3-524
KPEKGIGRNHQNPGHPSGASAAGRSVGSGRRLAGATTNSRFRFLQRGFVSGDVPAGQWKHDKFAELYGGGKKRMGGASLGPLKAVKGGAGSSIGARIARNAIERNSGGMVKLQVSNLPGSVVTLDLEELFQDFNVFGVAVHYDEMGNHLGTADLFTDQQSATNILNEFKNIAID

SEQ ID NO: 171005 - protein, 45 aa, Heterodera glycines
  Homolog annotation: Hit_ID=CAA07704.1; Match level="QueryCoverage =73%, HitCoverage=27%, E-value=2e-12, Identity=96%"; Hit description =lacZ' [Cloning vector pGreen]
  Coding regions on vcDNA: vcDNA=SeqID_97428; Strand=+; Position=407-541
FRTLVLKVVQLVSSRGGPVPNSPYSESYYNSLAVVLQRRDWENPG

SEQ ID NO: 171006 - protein, 100 aa, Heterodera glycines
  Coding regions on vcDNA: vcDNA=SeqID_97429; Strand=+; Position=53-355
EETDLEAFSTPLDDQGDNKPCLNVFVLFKHTLEEMNTRNSPLLVSISDQQRIGEARVAKLNHLMEICTREENLERSKRLAQAGGYSFDANAPVPTTFIFS

SEQ ID NO: 171007 - protein, 86 aa, Heterodera glycines; identical to SEQ ID NO: 167599
  Coding regions on vcDNA: vcDNA=SeqID_97430; Strand=-; Position=136-396

SEQ ID NO: 171008 - protein, 169 aa, Heterodera glycines
  Homolog annotation: Hit_ID=EAA67771.1; Match level="QueryCoverage =88%, HitCoverage=98%, E-value=2e-66, Identity=85%"; Hit description =RS14_NEUCR 40S ribosomal protein S14 (CRP2) [Gibberella zeae PH-1] ref|XP_382717.1| RS14_NEUCR 40S ribosom
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_97431; Strand=+; Position=3-512
GPPGCRNSARGTSLKPPKCLPRVKRSLQPQEAVSYGPQVREGELVFGVAHIFASFNDTFVHVTDLSGRETITRVTGGMKVKADRDESSPYAAMLAAQDVAVRCKELGITALHIKLRATGGVGPATPGPGAQSALRALARAGMRIGRIEDVTPIPTDSTRRKGGRRGRRL

SEQ ID NO: 171009 - protein, 77 aa, Heterodera glycines
  Coding regions on vcDNA: vcDNA=SeqID_97432; Strand=+; Position=3-236
IFLCATNSLVLSALSGRHAFQHGHRPMERQPRKGKHRIRKQFGCLFLRLPHMQQRKKIKGAIGRKTALIFKNFICLQ

SEQ ID NO: 171010 - protein, 91 aa, Heterodera glycines
  Coding regions on vcDNA: vcDNA=SeqID_97433; Strand=-; Position=5-280
SAVSNFSNYVSALLIVEVQFPVVVMGPFQHFLLLFLMLSLRLHFLRCHLDLRLALFRECDHVAHVIAQGTRILILGLFEGKHPLRSSLFDE

SEQ ID NO: 171011 - protein, 325 aa, Heterodera glycines
  Homolog annotation: Hit_ID=NP_057227.2; Match level="QueryCoverage =92%, HitCoverage=77%, E-value=3e-40, Identity=35%"; Hit description =p47 protein isoform a [Homo sapiens] emb|CAB96827.1| NSFL1C [Homo sapiens] gb|AAH02801.1| P47 protein, is
  Gene Ontology: Biological process=sporulation (sensu Saccharomyces)
  Coding regions on vcDNA: vcDNA=SeqID_97434; Strand=+; Position=57-1034
MSNIHTLGGDDDNKSRQRSNSSDDENSDEGRQGFFVGGSDHSGQEVLGPNRNENISADHFFDAIRRAGAERITQEQNEALNMPRQTGGGAGQSHVAFRLGGHGMESERIGGTSATAGGTTRQQAPVVVRLVFWNNGFTVDDGPLRQFQDPQNREFLQAVVTKRIPAELTMAAPGREIDLRIEKKGTEYEQPKTKAFSGQGNQLGTITPNVGGSADVVFVDAPPKLSAEETAKLVEQAQAELKEDDNLPTTRIQIRIPDTARPIVARLNQGHTVNQLRIFIVTADPSLAYRPFRLMTSYPTQPIDDEGLSVKDAGLLNATVLVKFE

SEQ ID NO: 171012 - protein, 37 aa, Heterodera glycines
  Coding regions on vcDNA: vcDNA=SeqID_97435; Strand=+; Position=3-113
MLSQYFAQKLYLCPHNRQRFDKKLLYCEKKKKKKKKK

SEQ ID NO: 171013 - protein, 172 aa, Heterodera glycines
  Homolog annotation: Hit_ID=EAA50962.1; Match level="QueryCoverage =87%, HitCoverage=37%, E-value=2e-35, Identity=50%"; Hit description =hypothetical protein MG04721.4 [Magnaporthe grisea 70-15] ref|XP _362276.1| hypothetical protein MG04721.4
  Coding regions on vcDNA: vcDNA=SeqID_97436; Strand=+; Position=104-701
MAASTPFATSAAPAPSRSKAPLGQATHSVDKNALGFDFNKLVLYLYQTVPQFIAPLRIEKFALGQSNPTFFLVDGREQKYVLRKKPAGALLSPTAHAVEREYKVLHGLGTCGHVPVPRVYTLCMDSSVIGTPFYVMEFVKGRIFPSPALPEIPATERRAYWEAAIRTLARLH

SEQ ID NO: 171014 - protein, 238 aa, Heterodera glycines
  Homolog annotation: Hit_ID=NP_991151.1; Match level="QueryCoverage =95%, HitCoverage=68%, E-value=6e-27, Identity=32%"; Hit description =mRNA decapping enzyme [Danio rerio] gb|AAP47149.1| histidine triad protein member 5 [Danio rerio]
  Gene Ontology: Cellular component=nucleus; Biological process=rRNA processing
  Coding regions on vcDNA: vcDNA=SeqID_97437; Strand=+; Position=3-716
MGAIFENIALHDFLVKEVINSFPDKKSIFLLLAKSDEKALLICNKQAFEEEVANVSDWLVKSKLRYIDSNDRFGNFEMALPSESNQIKVTFIYPATEWDIEKYSRQTPFFIYETPGDYQNITFDYLSENDYLKPLQWGYNFLRKKVSRSELGFEDEDKQNGFWSCAQFKMERDLCWMIFILLEIGNSPCFGSVRGLTSQQFPLFGKFSGPIRQFFQKKYGVGPKSLENGFPYPPNFYH

SEQ ID NO: 171015 - protein, 105 aa, Heterodera glycines
  Homolog annotation: Hit_ID=NP_496985.1; Match level="QueryCoverage =98%, HitCoverage=12%, E-value=7e-46, Identity=77%"; Hit description =trp-asp repeats containing protein (90.1 kD) (2O647) [Caenorhabditis elegans] emb|CAB76722.1| Hypothetica
  Gene Ontology: Mol. function=cleavage/polyadenylation specificity factor activity; Cellular component=nucleoplasm; Biological process =mRNA polyadenylation
  Coding regions on vcDNA: vcDNA=SeqID_97438; Strand=+; Position=3-317
PLATASDDATARVWDFARCAEERVMRGHGADVRSVDWHPTKGLLATGSRDSQQPVKLWDVKTGQCLATLHDHKNSVMAVQWNRNGNWLLTGSRDHVIKMYDVRMM

SEQ ID NO: 171016 - protein, 93 aa, Heterodera glycines
  Coding regions on vcDNA: vcDNA=SeqID_97439; Strand=+; Position=49-327
ENERHFRNPFLENVADGARAVSREWLLQKLETLTERIASRKIRAEENGKVGPYVGPSGIAYSLIKASRKLNQSQSNLSDYIRTLLATESDYDA

SEQ ID NO: 171017 - protein, 46 aa, Heterodera glycines; identical to SEQ ID NO: 167583
  Coding regions on vcDNA: vcDNA=SeqID_97440; Strand=-; Position=3-140

SEQ ID NO: 171018 - protein, 164 aa, Heterodera glycines
  Homolog annotation: Hit_ID=ZP_00284411.1; Match level="QueryCoverage =98%, HitCoverage=92%, E-value=3e-32, Identity=43%"; Hit description =COG3195: Uncharacterized protein conserved in bacteria [Burkholderia fungorum LB400]
  Coding regions on vcDNA: vcDNA=SeqID_97441; Strand=+; Position=71-562
MKIEELNDLDAENFVSKLGKIFENSAWVVQEAYGERPFEGVDQLFNAMERVLMNAGREKQLKLIQAHPDLAGNEMFSGNLTQHSTSEQANAGLNALTAQQLSEFNSLNSAYKSRFNFPFIIALRDQKEGIDGILAAFRLRLNNSEEQEINEALSQIGRIARHRL

SEQ ID NO: 171019 - protein, 209 aa, Heterodera glycines
  Coding regions on vcDNA: vcDNA=SeqID_97442; Strand=+; Position=1-630
HRQGGTGQRRAVERALRMPRRRLENFWRSIGMHSRSAKRQQCVRVAEQRIVRIAQSMHFLVFPTTNAEQTAVDKMGEVQLSKCAEQTAKIVDRVRVHRHSLCAGGAAGPSSFCCPSSFSSLSISNPPIAHYHNHHQQPKQHFHQQQQQLSFISAPCALHSSHGPSTTTANAIPAQLFMLSKNGRECSKLREMVSSLGEQLNVPSTTKIS

SEQ ID NO: 171020 - protein, 153 aa, Heterodera glycines
  Homolog annotation: Hit_ID=NP_080647.2; Match level="QueryCoverage =66%, HitCoverage=51%, E-value=3e-11, Identity=37%"; Hit description =loss of heterozygosity, 12, chromosomal region 1 homolog [Mus musculus] gb|AAH23059.1| Loss of heterozygo
  Coding regions on vcDNA: vcDNA=SeqID_97443; Strand=+; Position=66-524
MGNEHSPGRFGGNGTNKEKGDDDGGQTSPSTSTGIPASFSFLAKKRNSTKSALMGSIVVVNEGASCSSSADPGKDVDLRRIKEIPRFLPLLRGVLPGHRDIPEAQQKIDSKSILSFMHRLQQHFKSCAQTVATEQGRMFARIVEIDQLISSLF

SEQ ID NO: 171021 - protein, 92 aa, Heterodera glycines
  Homolog annotation: Hit_ID=AAH79755.1; Match level="QueryCoverage =56%, HitCoverage=81%, E-value=1e-17, Identity=66%"; Hit description =Unknown (protein for IMAGE:6951677) [Xenopus laevis]
  Gene Ontology: Mol. function=structural constituent of cytoskeleton; Cellular component=intermediate filament; Biological process =cellular morphogenesis
  Coding regions on vcDNA: vcDNA=SeqID_97444; Strand=+; Position=64-342
MNSATMFTLLLIIGTVLALTIGMPTPGGSDESVASMRQKRGYGMSNGGGMGNGFGGGMGNGFGGGMGNGFGGGMGNGFGGGMGNGFGGGMGG

SEQ ID NO: 171022 - protein, 87 aa, Heterodera glycines; identical to SEQ ID NO: 167576
  Coding regions on vcDNA: vcDNA=SeqID_97445; Strand=-; Position=1-261

SEQ ID NO: 171023 - protein, 213 aa, Heterodera glycines
  misc_feature (10)..(10): Xaa can be any naturally occurring amino acid
  Coding regions on vcDNA: vcDNA=SeqID_97446; Strand=+; Position=30-668
KENDGKAMGXSANGFVAFGCERKRMGEEENGGKVFYLLLTTRLNKGHPRKIKLSHFYRLFDKMKRNGMATFQFADPNLTVYVSQADPKALCQFLLHLYGLLRHAVDANIRCSAPSCSSPANVPSSPPPIATVSTVHRQCTSAIASAKPTKICIQSRQEYQSMIRQASSANLQRLDIVGIGFRAVDIRWFGMRRLQQLSLAANKLGSDEWCTER

SEQ ID NO: 171024 - protein, 188 aa, Heterodera glycines
  Coding regions on vcDNA: vcDNA=SeqID_97447; Strand=+; Position=36-602
MPHIEIPPLRKYEYTFEHEKAAIFRWEKERRSERVEEETEQTQQMRKQRQRHMEEKGTKKDGERERAEEGQRRTERRRDNTLNNPEYRNGECFKIESHSLPSSNVSKPNQPPHFASSSLLKPVPMSKSSSNSLHVGIASTQNGNMLQKSTNNNTLNGLEEFEPRRDLFDLLELRSLDARKELEKFFDL

SEQ ID NO: 171025 - protein, 152 aa, Heterodera glycines
  Homolog annotation: Hit_ID=CAE67853.1; Match level="QueryCoverage =51%, HitCoverage=56%, E-value=5e-15, Identity=52%"; Hit description =Hypothetical protein CBG13442 [Caenorhabditis briggsae]
  Coding regions on vcDNA: vcDNA=SeqID_97448; Strand=+; Position=3-461
PLIVNPIRNIFVRNFACQFGPSELARSYVTDGPLTVSGRSAPVKKRTNAADEIARTKFELLEPIAVTDLPRAQQRFARQIHRSNRTRVQKIFAKNIKMIKNGLAGIALVVAIYLYTFFVMRKETFLEEIDEEMAIERGEMKLDDQGRLVAVK

SEQ ID NO: 171026 - protein, 102 aa, Heterodera glycines; identical to SEQ ID NO: 167559
  Homolog annotation: Hit_ID=CAE74055.1; Match level="QueryCoverage =97%, HitCoverage=24%, E-value=2e-29, Identity=60%"; Hit description =Hypothetical protein CBG21707 [Caenorhabditis briggsae]
  Gene Ontology: Mol. function=ATPase activity; Cellular component=26S proteasome; Biological process=ATP-dependent proteolysis
  Coding regions on vcDNA: vcDNA=SeqID_97449; Strand=+; Position=49-357

SEQ ID NO: 171027 - protein, 136 aa, Heterodera glycines
  Coding regions on vcDNA: vcDNA=SeqID_97450; Strand=+; Position=1-411
VHRRKFTSECEGQGGLSWCYICNTDGCNKSWKNSTFSSTTPTSTSTTTNKLSSTPLAEIKNKLQCLAWNICNLSTKLKQSKVSRRFSIGQNCEEMAKDWGQIEEDEKIGDEYDQSADEDGQVFLADFFVGRINAKI

SEQ ID NO: 171028 - protein, 208 aa, Heterodera glycines; identical to SEQ ID NO: 162247
  Homolog annotation: Hit_ID=CAE60439.1; Match level="QueryCoverage =83%, HitCoverage=43%, E-value=6e-45, Identity=53%"; Hit description =Hypothetical protein CBG04047 [Caenorhabditis briggsae]
  Gene Ontology: Mol. function=dihydroorotate dehydrogenase activity; Cellular component=mitochondrion; Biological process=pyrimidine base metabolism
  Coding regions on vcDNA: vcDNA=SeqID_97451; Strand=+; Position=192-815

SEQ ID NO: 171029 - protein, 191 aa, Heterodera glycines
  Homolog annotation: Hit_ID=NP_490843.1; Match level="QueryCoverage =95%, HitCoverage=36%, E-value=6e-51, Identity=55%"; Hit description =peptidase D, Xaa-Pro dipeptidase (1B816) [Caenorhabditis elegans] gb|AAK18972.1| Hypothetical protein K12
  Gene Ontology: Mol. function=metallocarboxypeptidase D activity; Biological process=amino acid metabolism
  Coding regions on vcDNA: vcDNA=SeqID_97452; Strand=+; Position=8-580
MGGAAPGTCVLLLGGKDNPRYNTDTTDSPFRQESYFFWAFGVHEPDCFAAVDVESGKSAIFPPKMSPDSAIWDGKIQPEKWFLDKYKVDHVNFQTNGAEIGQFLHKLFNAKKLLLLKAENTDSGNVLEPAKFPGMDSFSTDLASLYPTMAELRVIKTELELAVLRYASKIANEAHKEVMRHVRPEMYEYQL

SEQ ID NO: 171030 - protein, 151 aa, Heterodera glycines
  Homolog annotation: Hit_ID=NP_501506.1; Match level="QueryCoverage =68%, HitCoverage=34%, E-value=4e-10, Identity=35%"; Hit description =putative protein of bilaterial origin (33.1 kD) (4J506) [Caenorhabditis elegans] emb|CAA91036.1| Hypothet
  Coding regions on vcDNA: vcDNA=SeqID_97453; Strand=+; Position=74-526
MDESLGNKRPNSTVKEDDSVSLCGSVATTAAGDGSLLDFGLDEETLAVESDTEFERKFFVMKEGSFPGKVFALPHPASRERALYLLNEHGELFELLRLDNGKRSFFFFDSVVANGSVHLFFPVHPFFLAIECLQRNASEHFLTASELLEDD

SEQ ID NO: 171031 - protein, 75 aa, Heterodera glycines
  misc_feature (57)..(57): Xaa can be any naturally occurring amino acid
  misc_feature (59)..(59): Xaa can be any naturally occurring amino acid
  Homolog annotation: Hit_ID=CAB55572.1; Match level="QueryCoverage =100%, HitCoverage=31%, E-value=3e-19, Identity=54%"; Hit description= cytochrome oxidase subunit II [Globodera pallida]
  Coding regions on vcDNA: vcDNA=SeqID_97454; Strand=-; Position=3-227
NFFFNLNLGFGLLEFWICFIPIFFLISQIIPSIFLLFFFNFSNTSSDLTIKVVGHQXYXSYEIGDKVGFFFDSFI

SEQ ID NO: 171032 - protein, 104 aa, Heterodera glycines
  Coding regions on vcDNA: vcDNA=SeqID_97455; Strand=-; Position=2-313
ENIIYDKTKSEKQNKRGEEIMPRAKPNRGKGTTHFGTLFFHPKYPRGHHFAEEVKPKEELVQAVRLLLRLLFASSIFSHFLFFPLSHPPRFLRSPPFPFSFLYC

SEQ ID NO: 171033 - protein, 255 aa, Heterodera glycines
  Homolog annotation: Hit_ID=CAE57189.1; Match level="QueryCoverage =94%, HitCoverage=98%, E-value=9e-61, Identity=47%"; Hit description =Hypothetical protein CBG00033 [Caenorhabditis briggsae]
  Gene Ontology: Cellular component=integral to membrane
  Coding regions on vcDNA: vcDNA=SeqID_97456; Strand=+; Position=45-809
MFLSNFVAQTLPTMTEEWKDAVLYAPYQKEQALMYQYADTLAVRAFLMMADLSFVLEQRPNAEFMSPTGEVPFLRLQNTLVAEFFPIVDLVGKKGIRPSNTLSAAEQADIQAFCSLIEETLRNAEKYLSWLDDESYELVTKKRYGSVYLWPLNWLLPTLKRREMHNYLADIGWADLPIAKVAERCDKCFHALSIKLGQQQFFVGDQPTELDALAFGHLYTLLTTEMPNKAIVETLSKYPNLIAFCQTIDKEYFSQ

SEQ ID NO: 171034 - protein, 140 aa, Heterodera glycines
  Homolog annotation: Hit_ID=CAE72234.1; Match level="QueryCoverage =92%, HitCoverage=50%, E-value=4e-27, Identity=43%"; Hit description =Hypothetical protein CBG19349 [Caenorhabditis briggsae]
  Coding regions on vcDNA: vcDNA=SeqID_97457; Strand=+; Position=100-519
MSNFGYGQQQGQAYHPQGANPYQQQPGWNVPPPPQGQQPYNAQHFAEQGQAGMPKNELGFNDQTIRSQFVRKVFSTVGIMLAVVAVMSAFPFMHPPMMAFVRHNVGLYLLGYITFFVVYIALICCEGVRRSFPANIILLG

SEQ ID NO: 171035 - protein, 72 aa, Heterodera glycines
  misc_feature (72)..(72): Xaa can be any naturally occurring amino acid
  Coding regions on vcDNA: vcDNA=SeqID_97458; Strand=+; Position=113-328
LFSPPLLLRLNLNFILGLNIVYTILFSFVPSLSIISPSSFPIFIVFFSAGASVYSRHRLFQFLITCIKYLIX

SEQ ID NO: 171036 - protein, 72 aa, Heterodera glycines; identical to SEQ ID NO: 167537
  Coding regions on vcDNA: vcDNA=SeqID_97459; Strand=+; Position=2-220

SEQ ID NO: 171037 - protein, 69 aa, Heterodera glycines; identical to SEQ ID NO: 167532
  misc_feature (68)..(68): Xaa can be any naturally occurring amino acid
  Coding regions on vcDNA: vcDNA=SeqID_97460; Strand=-; Position=1-207

SEQ ID NO: 171038 - protein, 90 aa, Heterodera glycines; identical to SEQ ID NO: 162398
  Homolog annotation: Hit_ID=XP_325844.1; Match level="QueryCoverage =84%, HitCoverage=56%, E-value=4e-10, Identity=48%"; Hit description =predicted protein [Neurospora crassa] gb|EAA28659.1| predicted protein [Neurospora crassa]
  Coding regions on vcDNA: vcDNA=SeqID_97461; Strand=+; Position=104-376

SEQ ID NO: 171039 - protein, 61 aa, Heterodera glycines; identical to SEQ ID NO: 167524
  Coding regions on vcDNA: vcDNA=SeqID_97462; Strand=+; Position=196-381

SEQ ID NO: 171040 - protein, 225 aa, Heterodera glycines
  Homolog annotation: Hit_ID=CAE57570.1; Match level="QueryCoverage =100%, HitCoverage=53%, E-value=4e-84, Identity=66%"; Hit description= Hypothetical protein CBG00548 [Caenorhabditis briggsae]
  Gene Ontology: Mol. function=RNA binding; Cellular component=nucleus; Biological process=mRNA cleavage
  Coding regions on vcDNA: vcDNA=SeqID_97463; Strand=+; Position=24-698
MKPDLKDPYFMYKLIVGQLFYDGHQQLALNLAQTLGLSLRPPPPSDKLFRLVAIAKQFVEDPESKERETILQVGGFESAGLDLEFDADVVPTSPEPSLYETVYLTTHKAPCRAAAFSPDGALVATASNDCSIKILDVDKIISRIDVTLSESGPDAHHPVIRTLYDHLDEVTCVAFHPRESVLLSGSNDFTLKMFDYSKTAGKRAMKTITEVKAIPAVSFHPSGEF

SEQ ID NO: 171041 - protein, 103 aa, Heterodera glycines; identical to SEQ ID NO: 167518
  Homolog annotation: Hit_ID=NP_508475.1; Match level="QueryCoverage =100%, HitCoverage=14%, E-value=4e-17, Identity=40%"; Hit description= putative protein, with 2 coiled coil-4 domains, of fungal and metazoan origin (XD302) [Caenorhabditis el
  Gene Ontology: Cellular component=mitochondrial inner membrane
  Coding regions on vcDNA: vcDNA=SeqID_97464; Strand=+; Position=3-314

SEQ ID NO: 171042 - protein, 113 aa, Heterodera glycines
  Homolog annotation: Hit_ID=NP_496985.1; Match level="QueryCoverage =93%, HitCoverage=12%, E-value=2e-09, Identity=36%"; Hit description =trp-asp repeats containing protein (90.1 kD) (2O647) [Caenorhabditis elegans] emb|CAB76722.1| Hypothetica
  Coding regions on vcDNA: vcDNA=SeqID_97465; Strand=+; Position=2-340
IIDNDMPEGPGRRLRKNVANVRKHIDYIANALNHMEGSLWEEPDRSQLRWERRGIKGDIRYQGNGLRPRLTTKVPEERRLEEIRARRDEAKGRERIKTVSWTTGGQTSRLAAA

SEQ ID NO: 171043 - protein, 67 aa, Heterodera glycines
  Coding regions on vcDNA: vcDNA=SeqID_97466; Strand=-; Position=203-406
LLSSSSSSCFCFCVAFTAPQQMAESERFQSAVEERADEKKSSDWSANRSTKGQQVNAVLNCSGGGGN

SEQ ID NO: 171044 - protein, 154 aa, Heterodera glycines
  Homolog annotation: Hit_ID=CAE56103.1; Match level="QueryCoverage =64%, HitCoverage=28%, E-value=7e-26, Identity=57%"; Hit description =Hypothetical protein CBG23701 [Caenorhabditis briggsae]
  Coding regions on vcDNA: vcDNA=SeqID_97467; Strand=+; Position=247-708
MKYTDSKIHDGKTNTQSDTETKNLLDDMGEEMDDDLSILHEMNCRSKQNGSSELDSKLFELSDEQLNYYTNCFLFLMQKSQGFFSLQGALQGNDRTILDFFRKSSLDDSILSKIWSLSDVNEDGFLNLTEFILAMHLVVLHTKGSVPIPSRLPS

SEQ ID NO: 171045 - protein, 128 aa, Heterodera glycines
  Coding regions on vcDNA: vcDNA=SeqID_97468; Strand=+; Position=1-384
KGPKSQKNETEKPPQQKQPQEKPGAQQDDTETEEDSKEDKRKPIKCQEERKCYAHSECGARSKCKPATLDRKKKVGTCDCGVCGGFQLLLLCSLNSGALSLDKNIVPRECAGLKDACVEKPLFVGSKS

SEQ ID NO: 171046 - protein, 31 aa, Heterodera glycines; identical to SEQ ID NO: 167504
  Coding regions on vcDNA: vcDNA=SeqID_97469; Strand=-; Position=56-151

SEQ ID NO: 171047 - protein, 66 aa, Heterodera glycines
  Coding regions on vcDNA: vcDNA=SeqID_97470; Strand=-; Position=1-198
QMRFSLPWGARVYNELRILHRIKWYFSLFSRAYFFTLFLCFSPLSYSEFAYLCPGGAEFGAGYWAI

SEQ ID NO: 171048 - protein, 141 aa, Heterodera glycines
  Homolog annotation: Hit_ID=NP_608830.3; Match level="QueryCoverage =100%, HitCoverage=99%, E-value=2e-72, Identity=87%"; Hit description= CG3058-PA [Drosophila melanogaster] gb|AAF51017.2| CG3058-PA [Drosophila melanogaster] gb|EAL34050.1| GA
  Gene Ontology: Mol. function=pre-mRNA splicing factor activity; Cellular component=small nuclear ribonucleoprotein complex; Biological process=cell cycle
  Coding regions on vcDNA: vcDNA=SeqID_97471; Strand=+; Position=2-427
SYMLPHLHNGWQVDQAILAEEDRVVLIRFGHDWDPSCMRMDETLYKIANKVKNFAVIYLVDISEVPDFNKMYELYDPVTAMFFFRNKHIMIDLGTGNNNKINWPMHDGQELIDIIETVYRGARKGRGLVISPKDYSTKYKY

SEQ ID NO: 171049 - protein, 64 aa, Heterodera glycines
  misc_feature (2)..(2): Xaa can be any naturally occurring amino acid
  misc_feature (8)..(8): Xaa can be any naturally occurring amino acid
  misc_feature (11)..(11): Xaa can be any naturally occurring amino acid
  Coding regions on vcDNA: vcDNA=SeqID_97472; Strand=-; Position=37-231
GXKKKNPXLSXPSKEETSESCNDACHMFIAYAIRCNRRTERETGLQNRSYVTLSVKKPKKRRKL

SEQ ID NO: 171050 - protein, 73 aa, Heterodera glycines
  Coding regions on vcDNA: vcDNA=SeqID_97473; Strand=+; Position=2-220
CSNLDPALINVLLDDVQLLTDSQTDNDTLLFPIVKAFRQLHAQLKEELSCVLSGQIGSEPKPFTLLSILEKQP

SEQ ID NO: 171051 - protein, 144 aa, Heterodera glycines
  Coding regions on vcDNA: vcDNA=SeqID_97474; Strand=-; Position=41-475
IVTRLTIGRIGYRAPPRVFFFFFFFFFFFFFLMCFFYCAFKKDYICTFFKFIFIKSFKSVVVVVREASLNAVSVRTFKESNKLANSDLSACFHGNSSARVVHILSHHLLRLPSSFVCFNNLNNSHFYNCFAHFGSNLWNSDYEL

SEQ ID NO: 171052 - protein, 78 aa, Heterodera glycines; identical to SEQ ID NO: 167491
  Homolog annotation: Hit_ID=NP_598698.1; Match level="QueryCoverage =80%, HitCoverage=84%, E-value=2e-13, Identity=49%"; Hit description =RIKEN cDNA 6720456B07 [Mus musculus] gb|AAH10582.1| RIKEN cDNA 6720456B07 [Mus musculus] dbj|BAC25616.1|
  Coding regions on vcDNA: vcDNA=SeqID_97475; Strand=+; Position=2-238

SEQ ID NO: 171053 - protein, 73 aa, Heterodera glycines
  Coding regions on vcDNA: vcDNA=SeqID_97476; Strand=+; Position=48-269
NLNEKRRSAVVELDSLNTGAAVVRHAQAMLIVRAGNYVCQFSTCSASVWALPHAEIKTEKKAAAKEGSDIFFF

SEQ ID NO: 171054 - protein, 122 aa, Heterodera glycines; identical to SEQ ID NO: 167489
  Homolog annotation: Hit_ID=NP_495324.2; Match level="QueryCoverage =54%, HitCoverage=6%, E-value=1e-12, Identity=49%"; Hit description =human WeRNer syndrome related (118.5 kD) (wrn-1) [Caenorhabditis elegans] gb|AAA68410.2| Human wrn (werner
  Gene Ontology: Mol. function=3'-5' exonuclease activity; Cellular component=nucleus; Biological process=aging
  Coding regions on vcDNA: vcDNA=SeqID_97477; Strand=+; Position=61-426

SEQ ID NO: 171055 - protein, 82 aa, Heterodera glycines; identical to SEQ ID NO: 167485
  Coding regions on vcDNA: vcDNA=SeqID_97478; Strand=+; Position=2-250

SEQ ID NO: 171056 - protein, 155 aa, Heterodera glycines
  Coding regions on vcDNA: vcDNA=SeqID_97479; Strand=+; Position=52-519
ALMLTLSVQPTPVVRFTRYMTTPVFDDELHHLIWTEMHWLRDRNYIMWVRLVLDGLRALIVDRHNTLGIGPAQQLAAANKKCASHGFVIFSAFIAVLCSIVGTMCAPLLWHKCCERFGPIVGKPSLPFPMVRFNNERDIGPYTTTNNGHQQQQQQ

SEQ ID NO: 171057 - protein, 99 aa, Heterodera glycines
  Coding regions on vcDNA: vcDNA=SeqID_97480; Strand=-; Position=141-440
CLLLVEWAFQGFIYQKLMQGRDSTYRYFGKAYYIKFILNVLCHLVGWAFTIHSVLYPKFETQLVRHLRLKITGTVRLERMETRSSHVIQLQKQNRWLIT

SEQ ID NO: 171058 - protein, 203 aa, Heterodera glycines
  misc_feature (82)..(82): Xaa can be any naturally occurring amino acid
  Homolog annotation: Hit_ID=NP_741361.1; Match level="QueryCoverage =84%, HitCoverage=44%, E-value=1e-33, Identity=41%"; Hit description =cytoplasmic protein of ancient origin precursor family member (4E502) [Caenorhabditis elegans] gb|AAM9796
  Coding regions on vcDNA: vcDNA=SeqID_97481; Strand=+; Position=110-717
KNPPSAGDPRSWRDFIKWKWDAKSTKLPNLKVLDQTLPVLKPRFQTDSRLSATWLGHATLFVRIDGISVLTDPCKFRQNFQXVWAMFATPSFLPFFKFCPRFRPPPCKIEELPKIDIVLISHNHYDHLDVVAVRELAQHFPHIIWVVPLGLKQLVQHETNSKAVHEMNWGDRLELQLNERTFEVFSVPAQHWSQRNLIDRNTS

SEQ ID NO: 171059 - protein, 234 aa, Heterodera glycines
  Homolog annotation: Hit_ID=NP_510647.1; Match level="QueryCoverage =98%, HitCoverage=54%, E-value=5e-84, Identity=62%"; Hit description =serum and Glucocorticoid inducible kinase homolog (sgk-1) [Caenorhabditis elegans] emb|CAB03485.1| Hypoth
  Gene Ontology: Mol. function=sodium channel regulator activity; Biological process=protein amino acid phosphorylation
  Coding regions on vcDNA: vcDNA=SeqID_97482; Strand=+; Position=2-703
FHIHLQKERSFAEPRLRGYAAEVASALGYLHAKDIIYRDLKPENLLLDRNGHVVLTDFGLCKEHVKMRQTTSTFCGTPEYLAPEVIQKKPYDRTVDWWCLGCVLFEMLFGLPPFYGKNQNEMYHKTLTQPLCVPSSASTLVRKLLVEILHKDRSERLGAKSDFEEIRSHPFFAPIDWDKLLNKEVKAPFVPKVRAETDTLNIAREFTDIEPNPASLVPLQTFVNRETEFAGFTY

SEQ ID NO: 171060 - protein, 86 aa, Heterodera glycines
  Homolog annotation: Hit_ID=CAE69829.1; Match level="QueryCoverage =60%, HitCoverage=6%, E-value=2e-16, Identity=73%"; Hit description =Hypothetical protein CBG16150 [Caenorhabditis briggsae]
  Gene Ontology: Cellular component=rhabdomere; Biological process=cell motility
  Coding regions on vcDNA: vcDNA=SeqID_97483; Strand=+; Position=3-263
LCILFCNLCLFGSPFRHWRCLFVALFDRSADDTSNFDSEFTGEAPKLTPVDRLFLMNLDQNEFEGFTFVNAEFTPQGENKTADKTI

SEQ ID NO: 171061 - protein, 139 aa, Heterodera glycines
  Homolog annotation: Hit_ID=EAK80835.1; Match level="QueryCoverage =80%, HitCoverage=34%, E-value=1e-32, Identity=54%"; Hit description =hypothetical protein UM00667.1 [Ustilago maydis 521] ref|XP _398282.1| hypothetical protein UM00667.1 [Usti
  Gene Ontology: Biological process=mRNA splicing
  Coding regions on vcDNA: vcDNA=SeqID_97484; Strand=+; Position=69-485
MSMSSTSAASASATDAEAQVEFPIVCEPCLGTNPYMRMTRQPQGAQCKSCSRPFTTFRWSPGPGQRTRRTEICTSCAKLKNACQSCILDLEFGLSTRVRDAVLGLDSGANTSNDHNRQWLLRAAEQNLAKTGSGMVDYG

SEQ ID NO: 171062 - protein, 85 aa, Heterodera glycines
  Coding regions on vcDNA: vcDNA=SeqID_97485; Strand=+; Position=3-260
QFIFLLALLPFLLVPICCEQCSWDDVNNICVGDCSSLCVLKDFDNCNCNRLPKNLQFFKNRRNFGNLKALAKKEETNNGKLMYKK

SEQ ID NO: 171063 - protein, 125 aa, Heterodera glycines
  Homolog annotation: Hit_ID=NP_508842.1; Match level="QueryCoverage =100%, HitCoverage=37%, E-value=6e-67, Identity=98%"; Hit description= actin (act-4) [Caenorhabditis elegans] gb|AAK77622.1| Actin protein 4, isoform b [Caenorhabditis elegans
  Gene Ontology: Mol. function=structural constituent of cytoskeleton; Cellular component=cytoskeleton; Biological process=actin cytoskeleton organization and biogenesis
  Coding regions on vcDNA: vcDNA=SeqID_97486; Strand=+; Position=2-379
GNERFRCPEALFQPSFLGMESAGIHETSYNSIMKCDIDIRKDLYANTVLSGGSTMYPGIADRMQKEITALAPSTMKIKIIAPPERKYSVWIGGSILASLSTFQQMWISKSEYDESGPSIVHRKCF

SEQ ID NO: 171064 - protein, 176 aa, Heterodera glycines
  Homolog annotation: Hit_ID=CAE68996.1; Match level="QueryCoverage =87%, HitCoverage=31%, E-value=8e-38, Identity=55%"; Hit description =Hypothetical protein CBG14983 [Caenorhabditis briggsae]
  Gene Ontology: Mol. function=snRNA binding; Cellular component=small nuclear ribonucleoprotein complex; Biological process=growth
  Coding regions on vcDNA: vcDNA=SeqID_97487; Strand=+; Position=1-528
LPLVDPPGCRYKNEGLVSKAGSLMALAKCPPSTVQILGAEKALFRALKTKKDTPKYGIIYHAQLVTQAGQKSKGKIARKLAAKVSLATRVDALCDESLGNGQGIEARVYIEQAIKEADARGGAKKQRFSGVKQAPKGAYTFKKGEVHHYDAKFDMTLKKGTEQAEEPQQEEQQSGK

SEQ ID NO: 171065 - protein, 148 aa, Heterodera glycines; identical to SEQ ID NO: 163796
  Homolog annotation: Hit_ID=AAT92164.1; Match level="QueryCoverage =97%, HitCoverage=97%, E-value=8e-64, Identity=77%"; Hit description =ribosomal protein S15 [Ixodes pacificus]
  Gene Ontology: Mol. function=structural constituent of ribosome; Cellular component=cytosolic small ribosomal subunit (sensu Eukarya); Biological process=protein biosynthesis
  Coding regions on vcDNA: vcDNA=SeqID_97488; Strand=+; Position=3-449

SEQ ID NO: 171066 - protein, 216 aa, Heterodera glycines; identical to SEQ ID NO: 167475
  Homolog annotation: Hit_ID=NP_659425.1; Match level="QueryCoverage =92%, HitCoverage=93%, E-value=1e-32, Identity=37%"; Hit description =hypothetical protein MGC19780 [Homo sapiens] gb|AAH11706.1| Hypothetical protein MGC19780 [Homo sapiens]
  Gene Ontology: Cellular component=membrane; Biological process =protein modification
  Coding regions on vcDNA: vcDNA=SeqID_97489; Strand=+; Position=3-653

SEQ ID NO: 171067 - protein, 152 aa, Heterodera glycines
  Homolog annotation: Hit_ID=XP_391955.1; Match level="QueryCoverage =76%, HitCoverage=18%, E-value=1e-34, Identity=59%"; Hit description =similar to ENSANGP00000010338 [Apis mellifera]
  Gene Ontology: Mol. function=zinc ion binding; Cellular component =cytoskeleton; Biological process=signal transduction
  Coding regions on vcDNA: vcDNA=SeqID_97490; Strand=+; Position=3-461
PKQQLCALFRSSIPLLEPRIGCYSVLAQMSTEVEKAQKAKPGGDTIFGKIIRKEMPSTILYEDDEVLAFKDINPEAPVHFLVIPKKCITALSNSEEQDQAVLGKLLLTANNVAKAQGLSNGYRIVINNGRHGCQRTSGTFLHTLLEKFGYFK

SEQ ID NO: 171068 - protein, 96 aa, Heterodera glycines
  Homolog annotation: Hit_ID=NP_996018.1; Match level="QueryCoverage =82%, HitCoverage=63%, E-value=2e-15, Identity=51%"; Hit description =CG33276-PA [Drosophila melanogaster] gb|AAS65063.1| CG33276-PA [Drosophila melanogaster]
  Gene Ontology: Mol. function=protein tagging activity; Biological process=protein modification
  Coding regions on vcDNA: vcDNA=SeqID_97491; Strand=+; Position=12-302
NGNKIGICRRAFAIFNGKRETEAENDNISTVRQLLRWLSDGPLRGNDRSEMLIQRDTVRPGVLVLINDTDWEILGGLDAQLNGGDKVTFISTLHGG

SEQ ID NO: 171069 - protein, 162 aa, Heterodera glycines
  Homolog annotation: Hit_ID=NP_741153.1; Match level="QueryCoverage =98%, HitCoverage=36%, E-value=4e-55, Identity=62%"; Hit description =chaperonin Containing TCP-1 (58.9 kD) (cct-6) [Caenorhabditis elegans] gb|AAC46642.1| Chaperonin containi
  Gene Ontology: Mol. function=chaperone activity; Cellular component =cytoplasm; Biological process=protein folding
  Coding regions on vcDNA: vcDNA=SeqID_97492; Strand=+; Position=2-487
VSLQAEREYITRRVLTFVELKETVCAGGDQGFVVINQKGIDPPSLDLLAQHGILALRRAKRRNMERLQLACGGEAVNSVDDLTPDVLGWAGSVYEHVLGEDKYTFVEECTNALKDGAVLPGAGAFEIAGYCALKKLADNVKGRAKLGVLAFAEALLVIPKTL

SEQ ID NO: 171070 - protein, 72 aa, Heterodera glycines
  Coding regions on vcDNA: vcDNA=SeqID_97493; Strand=-; Position=11-229
CSSRLSVQISHQSPFHRQIRRQIHRRRSHNAFAEVEHFQFDCPLLAWQLLMKGKWQLSAEEQKWWTKKTFSV

SEQ ID NO: 171071 - protein, 152 aa, Heterodera glycines; identical to SEQ ID NO: 157867
  Homolog annotation: Hit_ID=CAE72023.1; Match level="QueryCoverage =68%, HitCoverage=73%, E-value=3e-16, Identity=38%"; Hit description =Hypothetical protein CBG19105 [Caenorhabditis briggsae]
  Coding regions on vcDNA: vcDNA=SeqID_97494; Strand=+; Position=38-496

SEQ ID NO: 171072 - protein, 31 aa, Heterodera glycines
  misc_feature (11)..(11): Xaa can be any naturally occurring amino acid
  misc_feature (19)..(19): Xaa can be any naturally occurring amino acid
  Homolog annotation: Hit_ID=XP_472593.1; Match level="QueryCoverage =100%, HitCoverage=31%, E-value=5e-12, Identity=80%"; Hit description= OSJNBa0006B20.16 [Oryza sativa (japonica cultivar-group)] emb|CAE02748.2| OSJNBa0006B20.16 [Oryza sativa
  Coding regions on vcDNA: vcDNA=SeqID_97495; Strand=-; Position=10-102
PPPACPPPPSXPPPPPPPXPPLPPPPPPPPP

SEQ ID NO: 171073 - protein, 38 aa, Heterodera glycines
  Coding regions on vcDNA: vcDNA=SeqID_97496; Strand=+; Position=3-119
FLLLALWTNVPFLQASFVIFDHFQYLPAFVSFTLLSMF

SEQ ID NO: 171074 - protein, 42 aa, Heterodera glycines; identical to SEQ ID NO: 167462
  Coding regions on vcDNA: vcDNA=SeqID_97497; Strand=+; Position=49-177

SEQ ID NO: 171075 - protein, 44 aa, Heterodera glycines; identical to SEQ ID NO: 167461
  Homolog annotation: Hit_ID=NP_505678.1; Match level="QueryCoverage =93%, HitCoverage=12%, E-value=4e-12, Identity=73%"; Hit description =COLlagen structural gene (30.1 kD) (col-12) [Caenorhabditis elegans] emb|CAA98257.1| Hypothetical protein
  Gene Ontology: Mol. function=structural constituent of cuticle; Cellular component=extracellular; Biological process=cuticle biosynthesis (sensu Nematoda)
  Coding regions on vcDNA: vcDNA=SeqID_97498; Strand=+; Position=2-136

SEQ ID NO: 171076 - protein, 176 aa, Heterodera glycines
  Coding regions on vcDNA: vcDNA=SeqID_97499; Strand=+; Position=2-529
FFISGVRACQRISMHPYKHQLAAANECCFIYPFPAYGLSSRQLMRVLSAWLMPSFSADEEGPSMNVPSCFSDIDSSFECASFSVPMVFSHDEWFVQCVPALGEQLDKLLLLSQHHFFIGRKLMPPTTTEYGRRRGVSCATGAAPFARVDHPNSDADTAQGRNATVHCGFRHFAPLV

SEQ ID NO: 171077 - protein, 138 aa, Heterodera glycines; identical to SEQ ID NO: 163938
  Homolog annotation: Hit_ID=NP_501697.1; Match level="QueryCoverage =89%, HitCoverage=5%, E-value=2e-17, Identity=37%"; Hit description =predicted CDS, integrase, catalytic domain containing protein family member (4K310) [Caenorhabditis elegan
  Coding regions on vcDNA: vcDNA=SeqID_97500; Strand=+; Position=352-765

SEQ ID NO: 171078 - protein, 161 aa, Heterodera glycines
  Coding regions on vcDNA: vcDNA=SeqID_97501; Strand=-; Position=7-492
PVVGGAVPPLPTAVSVAVLWCAVIITAAFRRPLTNGMYAVARTAFRKYSIASANWWPKARSACTVVVSLNSFRPMPWADVPLCSADNDATPSAVPSALLLGVSGSKRRNGLSKGERISGGPHSEWEEKSEEQTMPFTIRLPAVLVEQNAAIIVKSAEIQTA

SEQ ID NO: 171079 - protein, 110 aa, Heterodera glycines
  Homolog annotation: Hit_ID=NP_510634.1; Match level="QueryCoverage =63%, HitCoverage=21%, E-value=4e-12, Identity=50%"; Hit description =misexpression suppressor of KSR (35.6 kD) (XQ738) [Caenorhabditis elegans] emb|CAA92227.1| Hypothetical p
  Coding regions on vcDNA: vcDNA=SeqID_97502; Strand=+; Position=56-489
SVQVEIQWKQCLYNPIVAPFADVGSYPIFTDEFKGTRKCTLDVYVQGNLEHLDDKVVFLTVHDVGKTYLSCVDLANSPTLSPLVGQRAVFLHVSVPGQAPGAENFVGDFP

SEQ ID NO: 171080 - protein, 41 aa, Heterodera glycines
  Coding regions on vcDNA: vcDNA=SeqID_97503; Strand=-; Position=1-123
PIQIVTSHFLLIIFFQNNFFFFGLYEPSPRSDAPRFMGRAN

SEQ ID NO: 171081 - protein, 222 aa, Heterodera glycines
  Homolog annotation: Hit_ID=CAE72569.1; Match level="QueryCoverage =98%, HitCoverage=13%, E-value=3e-46, Identity=45%"; Hit description =Hypothetical protein CBG19756 [Caenorhabditis briggsae]
  Gene Ontology: Mol. function=protein carrier activity; Biological process=intracellular protein transport
  Coding regions on vcDNA: vcDNA=SeqID_97504; Strand=+; Position=5-670
MKSGYQRELTYRRPDNSFSAFGESDQHGSTWLTAFVLRSFKQAQAYIFVDDRVLEDSIAFLISQQLDNGAFVERGEVHHKLMQGGASEGGFTLTAYVLIALLENHVQNKVTELARSYLESHLTDFKEDPYALALCTYVLHLANSPKKGDVLKMLEGLQITGATDGMVHWTTKVSNGAKDGTGGAAKNGGGAARDTNQYFFQPQPADVEMSAYALLTYMLLDN

SEQ ID NO: 171082 - protein, 205 aa, Heterodera glycines
  Homolog annotation: Hit_ID=NP_506153.1; Match level="QueryCoverage =89%, HitCoverage=9%, E-value=3e-34, Identity=38%"; Hit description =TEMO (5N87) [Caenorhabditis elegans] emb|CAA98425.1| Hypothetical protein C14C10.5 [Caenorhabditis elegans
  Coding regions on vcDNA: vcDNA=SeqID_97505; Strand=+; Position=209-823
MPLAEQLLSDYPGICHKPAWPLPDKQKLGEFREREAEICGRNRENFLALAEKLLTIAKDENLHWRQVDFAETLLSLLLRKDCDLPDGVVLHFFKRLTAATINIRKIAIDFCSSWLKIHRQKAVKEDVVIPDCPPGRGPGAQWPITFGIRSDNKFLLFDAANAPSNADKWDSANFHSKVYPGFYTWPSKFRVYAPPSEQKWANREF

SEQ ID NO: 171083 - protein, 147 aa, Heterodera glycines
  Coding regions on vcDNA: vcDNA=SeqID_97506; Strand=-; Position=2-442
MTMRYFSGRKRHQGVLCVFKKGFRISVSAGNKPSPACGPMDVILKASTGCAAFLLPYGKTAHSTFSLVRDVSLDRLPSIPLESFFPRRIREAQLIIIDEITMLHSTVIEVIDRVCKEFPIATSRVLRRKDPHCSGTWNSPSCRICSP

SEQ ID NO: 171084 - protein, 255 aa, Heterodera glycines
  Homolog annotation: Hit_ID=NP_490803.1; Match level="QueryCoverage =85%, HitCoverage=50%, E-value=2e-37, Identity=41%"; Hit description =hepatocyte nuclear factor 1, N-terminal and homeobox (47.0 kD) (1B465) [Caenorhabditis elegans] gb|AAC782
  Coding regions on vcDNA: vcDNA=SeqID_97507; Strand=+; Position=1-765
AEPLGIGSVWGAGDAALCSDSYPPAMFVQDPCTRLETSAEGELVPQRRERYVFRPVLLRVLETYFQKCPFPDIAKRVEIANACNAHLQVDKRGVQLMPKEVVTPQVIANWFANKRKEMRRRMGGTEAGRSRLNSLSAGRSNSPSSPNSAAHSREGPFELRQNNQQSGNVDEAVLAHCDFLQAMPMSVPTASNQQQMLLISDQPESVPSAADLALVLPPLGPPHHPNCCPPATPLLPPNVVQFCPSVDQQLLHLLQ

SEQ ID NO: 171085 - protein, 160 aa, Heterodera glycines
  Coding regions on vcDNA: vcDNA=SeqID_97508; Strand=+; Position=2-481
LRDCYVIFLSKFLCLENDKKISVNNRSLPQQNDTFLQIEQCVREMLLEKESRRDLFHCSLRPALGHFVALLLHSFGNDSDVNLRLRSGEFLCLLTQLDFADESADFVAFVLPGVFSGCRQILLNVLPNLHSIDLVRCACELVTNSICISFSKINVTDCLS

SEQ ID NO: 171086 - protein, 138 aa, Heterodera glycines
  Homolog annotation: Hit_ID=NP_699909.1; Match level="QueryCoverage =97%, HitCoverage=29%, E-value=3e-24, Identity=41%"; Hit description =glutamine synthetase family protein [Brucella suis 1330] gb|AAN33914.1| glutamine synthetase family prote
  Coding regions on vcDNA: vcDNA=SeqID_97509; Strand=+; Position=66-479
MTLTMDELRNKVQNGQISTVVVGSVDLHGRLIGKRLTARHFVEMAQKKDKMSMCYYFLAMTIEGHVAEGFEVARWENGFGNGLLQLDFGTLCRTPWMEKTALIMADMHDHRDLPFFCAPRTILRRQLQKLSEKGFRAK

SEQ ID NO: 171087 - protein, 46 aa, Heterodera glycines
  Coding regions on vcDNA: vcDNA=SeqID_97510; Strand=+; Position=1-141
QHSSTLSCDFERRKAGLQQRWGRRVFELRPEVFICCYIMPKLFSKF

SEQ ID NO: 171088 - protein, 31 aa, Heterodera glycines
  Coding regions on vcDNA: vcDNA=SeqID_97511; Strand=-; Position=2-94
PIGDPSVGQIFSFYLKFAFFPSGQFVVTERK

SEQ ID NO: 171089 - protein, 126 aa, Heterodera glycines
  Coding regions on vcDNA: vcDNA=SeqID_97512; Strand=-; Position=107-487
VGSLRGGGWRLELSAGGLRWSADGEGFVFPGRGTKKFVGKREGTNWGGGEETERDTLKKRRRRKAETTRKGRRSGRARREGRMTPNDGSDWRGVGVPAVSHLAVPQILSCDQKEGLLNNLLRDGII

SEQ ID NO: 171090 - protein, 141 aa, Heterodera glycines
  Coding regions on vcDNA: vcDNA=SeqID_97513; Strand=-; Position=208-633
FGKEPQKSTKTFLRGIGFQGRRRSDDEFINDDSDSDYTPSAKKKGIVGKRIGRAKKRKRLLFPPNNRPKMKIRQMSSSSDDENELQLSDTDCEAGPSSRKKSKAPKSQMHHRKWGPKASSSEEEDDEDEETLGDKRGGQSH

SEQ ID NO: 171091 - protein, 137 aa, Heterodera glycines
  Coding regions on vcDNA: vcDNA=SeqID_97514; Strand=+; Position=180-593
FQLIKLCKFLLISATSSFLWSNCAFPFDQFPHFFDLSANISFGQCHSPFYCLIKIARNPSNYLHPFPNLFLISPTLRGSQMAPFSQSVPSLFLIKCAHSLLISAISPFFSSSNCPNLFWSIVFWLFLLISVTPLHLY

SEQ ID NO: 171092 - protein, 140 aa, Heterodera glycines
  Homolog annotation: Hit_ID=NP_001002546.1; Match level="QueryCoverage= 95%, HitCoverage=52%, E-value=7e-25, Identity=47%"; Hit description =VAMP (vesicle-associated membrane protein)-associated protein A, like [Danio rerio] gb|AAH76262.1| VAM
  Gene Ontology: Cellular component=integral to membrane; Biological process=nonselective vesicle transport
  Coding regions on vcDNA: vcDNA=SeqID_97515; Strand=+; Position=67-486
GPFTEYVNANLTLSNPSRKDVYFKVKTTAPKFYCVRPNSGVIKANDKTQINVMLQPVESPETLESERSRHKFMIQTAFAPDDEQLPVDQFWKTVDPTLVMDSKLRVVFQRPFGFGDENNRDETNATGPFFNFNKTGEPKN

SEQ ID NO: 171093 - protein, 89 aa, Heterodera glycines; identical to SEQ ID NO: 164000
  Coding regions on vcDNA: vcDNA=SeqID_97516; Strand=+; Position=401-667

SEQ ID NO: 171094 - protein, 49 aa, Heterodera glycines
  Coding regions on vcDNA: vcDNA=SeqID_97517; Strand=+; Position=187-336
HFEKKPDLLDKKSRPRKNPCSLKKGLDLGQENYRPEYRFKSNSKNFLLI

SEQ ID NO: 171095 - protein, 127 aa, Heterodera glycines; identical to SEQ ID NO: 125714
  Coding regions on vcDNA: vcDNA=SeqID_97518; Strand=-; Position=251-634

SEQ ID NO: 171096 - protein, 52 aa, Heterodera glycines
  Coding regions on vcDNA: vcDNA=SeqID_97519; Strand=+; Position=1-156
VFPFNQTIFKTQIGVQSYNFGIYESVVEKMLKLARFCGSAVANVGTILRRTK

SEQ ID NO: 171097 - protein, 166 aa, Heterodera glycines
  Homolog annotation: Hit_ID=NP_491075.2; Match level="QueryCoverage =95%, HitCoverage=36%, E-value=2e-10, Identity=30%"; Hit description =putative cytoplasmic protein of ancient origin (49.2 kD) (1D495) [Caenorhabditis elegans] gb|AAF36002.2|
  Coding regions on vcDNA: vcDNA=SeqID_97520; Strand=+; Position=12-509
MGSKRRFLLHFSQAHQTFRRAEFDAICQIKGISVVPNSPSDGIHIQSFEFQNDEFDVFRLLERAVLVKAAYELIAEGDGHEQVMAKLASDPSSSLARFDSADQSWSLLVRPHQKKRSGDYARSVVERYTAIPLLTLAPVDLAHPSNVFSVIEMYEANGRRETPDKV

SEQ ID NO: 171098 - protein, 73 aa, Heterodera glycines
  Coding regions on vcDNA: vcDNA=SeqID_97521; Strand=+; Position=2-223
LTLSCKHSVYIQIRFFLLDEADSLLGGQSDSAQIVHELHSRIPKYSEFGERFQMIVCSATLHNMAVQRLAVGR

SEQ ID NO: 171099 - protein, 50 aa, Heterodera glycines
  Coding regions on vcDNA: vcDNA=SeqID_97522; Strand=-; Position=68-220
PRPYLRRCPSRAVRETTTKCRPKNRPRRHSRPKRPLMYGHAIVNYYLFAV

SEQ ID NO: 171100 - protein, 104 aa, Heterodera glycines; identical to SEQ ID NO: 167395
  Coding regions on vcDNA: vcDNA=SeqID_97523; Strand=+; Position=29-343

SEQ ID NO: 171101 - protein, 53 aa, Heterodera glycines
  Coding regions on vcDNA: vcDNA=SeqID_97524; Strand=-; Position=1-159
LMPSKMERLLKTVILKDSWFQVDPNFVDDVGQTLLNKVLLSAPPTWSFTFRER

SEQ ID NO: 171102 - protein, 269 aa, Heterodera glycines
  Homolog annotation: Hit_ID=NP_490803.1; Match level="QueryCoverage =91%, HitCoverage=57%, E-value=1e-88, Identity=65%"; Hit description =hepatocyte nuclear factor 1, N-terminal and homeobox (47.0 kD) (1B465) [Caenorhabditis elegans] gb|AAC782
  Coding regions on vcDNA: vcDNA=SeqID_97525; Strand=+; Position=1-807
EAVETVGTDGHRTSPPSWQEPSGHQPTSSASGAAHALPPSSSNRPIRSQRTPMKEIITLDDPTELDEFMARGEEQCIHAMRAFITQFSLRQTTVATMTGVSQPYISKLLNGNHRELSLRCRKNIYCWYLNCRRHPEKLAMFVQDPCTRLETSAEGELVPQRRERYVFRPVLLRVLETYFQKCPFPDIAKRVEIANACNAHLQVDKRGVQLMPKEVVTPQVIANWFANKRKEMRRRMGGTEAGRSRLNSLSAGRSNSPSSPNSAAHSREG

SEQ ID NO: 171103 - protein, 63 aa, Heterodera glycines; identical to SEQ ID NO: 167238
  Coding regions on vcDNA: vcDNA=SeqID_97526; Strand=-; Position=9-200

SEQ ID NO: 171104 - protein, 96 aa, Heterodera glycines
  Coding regions on vcDNA: vcDNA=SeqID_97527; Strand=+; Position=119-409
KFHPIFCIIFSISVCLTAVNSQKSSSKVEHFGRRPNGKETPSRTFVRNCSLCSKRTCPREHLPLVPCFMQINATSCFIMAENLGFSMILDVSAFFF

SEQ ID NO: 171105 - protein, 76 aa, Heterodera glycines
  Coding regions on vcDNA: vcDNA=SeqID_97528; Strand=+; Position=59-286
GKLGEELPRHETNDGSEEVIRVTVKTIYEVTVCHKINWHLLYVRFAKKSAAIQSKKMVKRQVDSTSTALALYCKNC

SEQ ID NO: 171106 - protein, 248 aa, Heterodera glycines; identical to SEQ ID NO: 163910
  misc_feature (204)..(204): Xaa can be any naturally occurring amino acid
  Homolog annotation: Hit_ID=NP_509934.1; Match level="QueryCoverage =99%, HitCoverage=22%, E-value=9e-87, Identity=61%"; Hit description =FERM domain (protein 4.1-ezrin-radixin-moesin) (frm-3) [Caenorhabditis elegans] emb|CAB10024.1| Hypotheti
  Gene Ontology: Mol. function=Rho guanyl-nucleotide exchange factor activity; Cellular component=cytoskeleton
  Coding regions on vcDNA: vcDNA=SeqID_97529; Strand=+; Position=2-745

SEQ ID NO: 171107 - protein, 37 aa, Heterodera glycines
  Coding regions on vcDNA: vcDNA=SeqID_97530; Strand=+; Position=2-115
KAKMIPNYELKWHIWPFKLCLVSIYRFKSDHNNRHVC

SEQ ID NO: 171108 - protein, 181 aa, Heterodera glycines
  misc_feature (46)..(46): Xaa can be any naturally occurring amino acid
  misc_feature (97)..(97): Xaa can be any naturally occurring amino acid
  misc_feature (102)..(102): Xaa can be any naturally occurring amino acid
  Homolog annotation: Hit_ID=NP_068765.2; Match level="QueryCoverage =93%, HitCoverage=10%, E-value=6e-13, Identity=33%"; Hit description =BCL6 co-repressor-like 1 [Homo sapiens]
  Coding regions on vcDNA: vcDNA=SeqID_97531; Strand=-; Position=142-687
RPRLAPGPPRSSPLPSRAPLPSPVPLAAKGAGSLLTSSQLPAGLAXHCRAPRLPLPLRGASSPPASPLPPPSLTLLPASPEGAARAEVAPSARRTPXTGATXILLSAHRLPLRMTPALLPPPLPFLPPAVPPLRLPAPAPLLWAVPVPARSLHPRQCFPPQPLRRNIAIPLQTWRWGEGQK

SEQ ID NO: 171109 - protein, 55 aa, Heterodera glycines
  Homolog annotation: Hit_ID=CAE66303.1; Match level="QueryCoverage =85%, HitCoverage=14%, E-value=9e-09, Identity=53%"; Hit description =Hypothetical protein CBG11553 [Caenorhabditis briggsae]
  Coding regions on vcDNA: vcDNA=SeqID_97532; Strand=+; Position=3-170
NPLNLFTSNQGLEESRNIVLDYRKGIFSPELTVERLWKAKHLYGNLFMYFFLIGL

SEQ ID NO: 171110 - protein, 126 aa, Heterodera glycines
  misc_feature (118)..(118): Xaa can be any naturally occurring amino acid
  Homolog annotation: Hit_ID=NP_509544.1; Match level="QueryCoverage =56%, HitCoverage=31%, E-value=8e-18, Identity=61%"; Hit description =calmodulin (XJ770) [Caenorhabditis elegans] gb|AAA68320.1| Hypothetical protein B0563.7 [Caenorhabditis e
  Coding regions on vcDNA: vcDNA=SeqID_97533; Strand=+; Position=100-479
MSSGDEATTPALTSGGGASSTRTAGGGSAFQRWGGNRRGSHLVGWDSARPQSAARQQQQMLERMYSKSELHEYQQLFKMFDTDGSGAIGCEELKGAMLSIGLQADDAEIERLIKEVDXHGNGSIDM

SEQ ID NO: 171111 - protein, 273 aa, Heterodera glycines
  Homolog annotation: Hit_ID=NP_505312.1; Match level="QueryCoverage =84%, HitCoverage=16%, E-value=2e-19, Identity=30%"; Hit description =TPR repeat containing protein (5J441) [Caenorhabditis elegans] gb|AAC69037.1| Hypothetical protein T19A5.
  Coding regions on vcDNA: vcDNA=SeqID_97534; Strand=+; Position=15-836
MIGFDPTNEQNSGQQLFMGEIGQRINNLIKFNIGPKWMSLNFAALFFRFFGFPSEAANCLEAALTFPQFLDISLTQLAQLLLHLNPPMENAKKENDGIERILRIAMQKGENEPVPFHLMGIFHLRQNRSVLAYRFFREALDRDPNFEPALNELLRMKCTQRVGKKPRLIRDIYAPICCWPNEQNVVCFERRAKGSVWRESVRCFRLESPPVSSGGEFPAVHFVYFRCNTPYTGRSYPPPPFAPLVAPLLRPAGRNCVKLNFVDSSNKSRLRNH

SEQ ID NO: 171112 - protein, 51 aa, Heterodera glycines
  Coding regions on vcDNA: vcDNA=SeqID_97535; Strand=-; Position=2-154
PPPPPFFSLSPGPRGRYFRPFPRPLFPAGVFFIFFFPPPPYFGTPPPPEAG

SEQ ID NO: 171113 - protein, 70 aa, Heterodera glycines
  Homolog annotation: Hit_ID=NP_499279.1; Match level="QueryCoverage =92%, HitCoverage=26%, E-value=1e-18, Identity=63%"; Hit description =UNC50 (3L404) [Caenorhabditis elegans] pir||T24631 hypothetical protein T07A5.2 - Caenorhabditis elegans
  Coding regions on vcDNA: vcDNA=SeqID_97536; Strand=-; Position=75-348
KVLFALALNLSFSSFCAFFLWVVFIDCIGIGIAIATALWFISNRFLRRTRDCDVVEWAYCFDVHLNEIRN

SEQ ID NO: 171114 - protein, 172 aa, Heterodera glycines
  Homolog annotation: Hit_ID=NP_505633.1; Match level="QueryCoverage =95%, HitCoverage=57%, E-value=4e-45, Identity=42%"; Hit description =putative RNA binding protein with KH domain(s) family member (65.6 kD) (5K718) [Caenorhabditis elegans] e
  Gene Ontology: Mol. function=transcriptional activator activity; Cellular component=nucleus; Biological process=transcription
  Coding regions on vcDNA: vcDNA=SeqID_97537; Strand=+; Position=2-517
LLRGTNVGGGGGNASRSIGEVIVPRTSVGIIIGKGGETIKRLAAETGAKIQFRPDDPNLQERCAVIQGTPEQINRATQMISELVTRSSGGGGQQETFYMHVPANKTGLVIGKGGDTIKQISAETGAHVELSRDSPPNSTEKIFVIKVGDVAPGTPLPSFHGNAGITNATTPL

SEQ ID NO: 171115 - protein, 140 aa, Heterodera glycines
  Coding regions on vcDNA: vcDNA=SeqID_97538; Strand=+; Position=1-423
ETRQQKSLRGRLGIGTYELATDEAPIGNKKSGSERCGGICIIDPTDLLPIERYIRLPSGVFRLVKVPTNAITPLLTSEVNDNSAAVATLTDGRLALFTTDHFDSIADVSATFLPFSTTLSSGMMLDCAVNSDGRLLCSDK

SEQ ID NO: 171116 - protein, 174 aa, Heterodera glycines
  Homolog annotation: Hit_ID=NP_506706.1; Match level="QueryCoverage =100%, HitCoverage=21%, E-value=2e-47, Identity=56%"; Hit description= DNA replication licensing factor Mini Chromosome Maintenance (90.7 kD) (mcm-3) [Caenorhabditis elegans]
  Gene Ontology: Mol. function=DNA binding; Cellular component=alpha DNA polymerase:primase complex; Biological process=DNA replication initiation
  Coding regions on vcDNA: vcDNA=SeqID_97539; Strand=+; Position=144-665
HDVERDQTVAENVLKLHRYRPQGESVGAVQVFGTAMEVRTTFDAEKGDSHGRMEVYENIREWTAVEEGQKILSTQFMRKYIHTARDVKPKLTDEASTFISERYAELRSTDLIKTDCERTMPFTARQLETMIRLSTAMAKARLSKTVGLEDAKSAYELLDFACFKEKPRERLEYE

SEQ ID NO: 171117 - protein, 231 aa, Heterodera glycines
  Homolog annotation: Hit_ID=CAE56729.1; Match level="QueryCoverage =98%, HitCoverage=69%, E-value=1e-56, Identity=51%"; Hit description =Hypothetical protein CBG24516 [Caenorhabditis briggsae]
  Gene Ontology: Mol. function=protein binding; Cellular component =mitochondrion; Biological process=steroid metabolism
  Coding regions on vcDNA: vcDNA=SeqID_97540; Strand=+; Position=103-795
MKIQAGHRYEIGDQTGKTYIVTGATSGIGKTIATELAMKNAEVVMACRNRNKCLEVRRDIVLNTRNKKVFCRMCDLSDMESVHEFVRKMTKGKYDFKKIDGVILNAATKSKKYSTNKDGVETNLATNHLGSFLLVGLLLQKLLDQDGQSRIVFVGTDIATKNSLKLELGKLNTAKYTNKFLRSTEKLDIEKGKYDMHGAYKFSKLTQLVFARELAERLEGNNKIRAVVADP

SEQ ID NO: 171118 - protein, 51 aa, Heterodera glycines
  Coding regions on vcDNA: vcDNA=SeqID_97541; Strand=+; Position=184-336
SLPSSSRFVTHDLERGNQFQRRVDLAFKLQLSNLKLEFGNQIHETFGLVLG

SEQ ID NO: 171119 - protein, 153 aa, Heterodera glycines
  Coding regions on vcDNA: vcDNA=SeqID_97542; Strand=-; Position=200-661
NENNGKNNSPAGGHETDNWPTDGLSDGQSADGGQSEGRKSAKDEDVSLASVGVSKFVVVWACLFAPSSVCGIFPILASTRSPMARAWEGLHAGGKADIGGRGEAAEEKRLFSICAGGSVGYARAPFTGFSRRTNSEFPTHKRRNKSLTEKSNR

SEQ ID NO: 171120 - protein, 88 aa, Heterodera glycines
  Coding regions on vcDNA: vcDNA=SeqID_97543; Strand=-; Position=2-265
MNFYKSTTFIGLFFIILANSFFDHADDPKLASSFLCCAIVFHFSGQNFPFRHGSVNGHRTAGSFLCECTWGKEKNTGEKSNGQKKEEA

SEQ ID NO: 171121 - protein, 59 aa, Heterodera glycines
  Coding regions on vcDNA: vcDNA=SeqID_97544; Strand=+; Position=30-209
MNLPKECDGGGNAQRREDDNVEQQQEAAACSNSEAQQPANDEDEDDDDDGQTNFVCNRQ

SEQ ID NO: 171122 - protein, 40 aa, Heterodera glycines
  Coding regions on vcDNA: vcDNA=SeqID_97545; Strand=-; Position=0-119
KRCNPISSGGNSFIQASSKSKMEIRLRAVSPIIISDEVGG

SEQ ID NO: 171123 - protein, 47 aa, Heterodera glycines
  Coding regions on vcDNA: vcDNA=SeqID_97546; Strand=-; Position=1-141
RGIYHGIKTERQINETEMSDLINEKTNPSSKVVPLAKVLSRLLPRQE

SEQ ID NO: 171124 - protein, 126 aa, Heterodera glycines
  Coding regions on vcDNA: vcDNA=SeqID_97547; Strand=+; Position=19-396
TQLVALPPPMVLPPLCLLLPLIVLLIALFRLPLPLSSNNSRSISDTLWTRITSVSRVFSPPIRIFAALSSLKRPPVSLVFFGHSNVSALFPLLGRKAPEVISEKGYRANVPAWLVPAVDHICSFAV

SEQ ID NO: 171125 - protein, 86 aa, Heterodera glycines; identical to SEQ ID NO: 167289
  Coding regions on vcDNA: vcDNA=SeqID_97548; Strand=-; Position=5-265

SEQ ID NO: 171126 - protein, 74 aa, Heterodera glycines
  Homolog annotation: Hit_ID=NP_220760.1; Match level="QueryCoverage =98%, HitCoverage=14%, E-value=6e-26, Identity=67%"; Hit description =ADP,ATP CARRIER PROTEIN (tlc2) [Rickettsia prowazekii str. Madrid E] emb|CAA14836.1| ADP,ATP CARRIER PROT
  Coding regions on vcDNA: vcDNA=SeqID_97549; Strand=-; Position=3-224
FFGLILFPYQAYWHPNKLLIDQYIQLYPQLKWFFMMWSKWTLVCFYVMGELWPMIVFTLLYWQLANQITTIEEA

SEQ ID NO: 171127 - protein, 112 aa, Heterodera glycines
  Coding regions on vcDNA: vcDNA=SeqID_97550; Strand=-; Position=3-338
SYQFITLSTPSFAAFFSVLISAWGKAQTDAEQVEDGHTKLPARTISIACACRTTAAPVFKLSSSTTADRRFSFKFQHISSLGRAEGERSQKQAAENDRKKLGNHFCKLNFRK

SEQ ID NO: 171128 - protein, 29 aa, Heterodera glycines
  Coding regions on vcDNA: vcDNA=SeqID_97551; Strand=+; Position=68-154
LACLSLHLISLFILISLCHFCIAIKIHVI

SEQ ID NO: 171129 - protein, 128 aa, Heterodera glycines
  Coding regions on vcDNA: vcDNA=SeqID_97552; Strand=-; Position=241-627
TNTFSATKSGWFSFVYVLTSTGNCFSRSCKCQSVGGTRITIVATTVRLALSFGTSGITVTWFGLSTDVGTLVDATASLPALVSGVSQKLDLLAHTLVPVSQKLVLIAQKLVLVSQKTVLQQPIILFSQ

SEQ ID NO: 171130 - protein, 84 aa, Heterodera glycines
  Coding regions on vcDNA: vcDNA=SeqID_97553; Strand=+; Position=2-253
CMTQQREKVVVKPRPIAEATRRLERFAVPLMFSAPASVRLASPRRRRPFRAQIYSMRCSDCVRRFPPVARLFPRLRPLHGHRLA

SEQ ID NO: 171131 - protein, 187 aa, Heterodera glycines
  Homolog annotation: Hit_ID=NP_996512.1; Match level="QueryCoverage =99%, HitCoverage=51%, E-value=1e-57, Identity=61%"; Hit description =CG33253-PA [Drosophila melanogaster] gb|AAS65408.1| CG33253-PA [Drosophila melanogaster] gb|AAM29428.1| R
  Gene Ontology: Mol. function=protein binding; Cellular component =integral to membrane; Biological process=signal transduction
  Coding regions on vcDNA: vcDNA=SeqID_97554; Strand=+; Position=2-562
FTFPCTIFSCIKIVQQYERAVIFRLGRIRRKAQGPGLFFILPCVDEYRCVDLRTVTCDVPPQQVLSKDSVTVTVDAVVFYRVFNATQAVMMGNISSSTTLLAQTTLRHVFGTKTLSEILGNFNKINREMKLSMDKPSDVWGVEVELVELKNVRLPHDMQRSMAAEAEAGREARAKMVAAEGDHKRPR

SEQ ID NO: 171132 - protein, 36 aa, Heterodera glycines; identical to SEQ ID NO: 167273
  Coding regions on vcDNA: vcDNA=SeqID_97555; Strand=+; Position=2-112

SEQ ID NO: 171133 - protein, 88 aa, Heterodera glycines
  Homolog annotation: Hit_ID=EAL21618.1; Match level="QueryCoverage =100%, HitCoverage=96%, E-value=2e-36, Identity=79%"; Hit description= hypothetical protein CNBC6540 [Cryptococcus neoformans var. neoformans B-3501A]
  Coding regions on vcDNA: vcDNA=SeqID_97556; Strand=+; Position=21-287
MTKGTPSFGKRHTKSHTLCKRCGRRAFHNQKKTCAQCGYPSAKLRSFNWSEKAKRRKTTGTGRMRHLKNVNRRFGNGFRSGTPKAASA

SEQ ID NO: 171134 - protein, 151 aa, Heterodera glycines
  Coding regions on vcDNA: vcDNA=SeqID_97557; Strand=+; Position=1-456
LVDPRAAGIRHEGHVEDQLFDFYTPSEPKKKKLLHHPSAAASPVGARSSLSGTRIGSLALGSLTLNAAPDLELYSPALPPSASLNAVAPSKYGPSPAANSSARQLLGGGARGGDSVGSVPSAVAPDECPLKKKYAKEAWPAEMRRRSGSIL

SEQ ID NO: 171135 - protein, 70 aa, Heterodera glycines; identical to SEQ ID NO: 167268
  Coding regions on vcDNA: vcDNA=SeqID_97558; Strand=+; Position=25-237

SEQ ID NO: 171136 - protein, 154 aa, Heterodera glycines; identical to SEQ ID NO: 163885
  Homolog annotation: Hit_ID=EAA62601.1; Match level="QueryCoverage =100%, HitCoverage=99%, E-value=3e-62, Identity=74%"; Hit description= conserved hypothetical protein [Aspergillus nidulans FGSC A4] ref|XP _409578.1| conserved hypothetical pro
  Gene Ontology: Cellular component=mitochondrion
  Coding regions on vcDNA: vcDNA=SeqID_97559; Strand=+; Position=17-481

SEQ ID NO: 171137 - protein, 289 aa, Heterodera glycines
  Homolog annotation: Hit_ID=AAH57752.1; Match level="QueryCoverage =98%, HitCoverage=35%, E-value=7e-79, Identity=51%"; Hit description =MGC69128 protein [Xenopus laevis]
  Gene Ontology: Mol. function=glutamine-tRNA ligase activity; Cellular component=cytoplasm; Biological process=glutaminyl-tRNA aminoacylation
  Coding regions on vcDNA: vcDNA=SeqID_97560; Strand=+; Position=1-870
LLLKLIQAGIVDDWDDPRLFTLTALRRRGVPSETVNKFIAHLGLTVAQSSIDPAMFDAFLRDHLNVTAPRTMAVLEPLRLRITNYRELGFIPAKSTLRVKQFPSSINESTDEWEIAFDEFVYIEQAAFREVAEKSYRRLTLEQPVGLRHVNLAVKIDKLERDEHGNPIELVVTANPVSSECKPKAFIHWVARPVLCEVRLYDKLFVHKNPEDPAEVPGGFLTDINPNSLHVLSNAMVDGSIIRTIRPLDRFQFERNGFFCLDPNDSWSSEKKFVFNRIVSLREDAGKDI

SEQ ID NO: 171138 - protein, 116 aa, Heterodera glycines
  Coding regions on vcDNA: vcDNA=SeqID_97561; Strand=+; Position=1-351
ILLNFLIFNYFGSVTFNLGMPSHTLLILCLLFCFALTNGNANSDNDAEDTDIESFVRERCDSACEDPGETSEECAFVCLNCVQTECQHCTNGTESNGGTKEKCQKCFEENKAKCVQ

SEQ ID NO: 171139 - protein, 66 aa, Heterodera glycines
  Coding regions on vcDNA: vcDNA=SeqID_97562; Strand=-; Position=285-485
LSPPSSSFCCSSTTRSDGTATTSPAAEGGVSFLSSSAPFSTSPSAPPLPSSSSSSPSAFFGFMNRR

SEQ ID NO: 171140 - protein, 268 aa, Heterodera glycines
  Homolog annotation: Hit_ID=XP_320495.1; Match level="QueryCoverage =86%, HitCoverage=47%, E-value=9e-38, Identity=39%"; Hit description =ENSANGP00000015654 [Anopheles gambiae]
  Gene Ontology: Mol. function=SNARE binding; Cellular component=plasma membrane; Biological process=vesicle-mediated transport
  Coding regions on vcDNA: vcDNA=SeqID_97563; Strand=+; Position=1-804
APSTSLGAWLQTFNLLSSLVQRIKVPQKQKSVAEDRAMSDQIFTMLQHPARLDFLRVDHPELAAAYEKNPTDKDLFYIAFMKNKEEQTRRVRLMYDHSSEEGQRYIAQEIERERITRMQELAMEHMPEAFIPVHMLYIRMKINNHLVIAFVDSGAQASILSESCARRCDILKYVDRRYRVQAHGIGGSQKMVGRIFACQVQVDDNVFACPFEVMSDRDVDILFGLNAMLRHRCNIDLKKMVLRFGDGTETPFLSEQEVKREKEAIAMA

SEQ ID NO: 171141 - protein, 189 aa, Heterodera glycines
  Homolog annotation: Hit_ID=NP_493175.1; Match level="QueryCoverage =56%, HitCoverage=27%, E-value=9e-26, Identity=48%"; Hit description =predicted CDS, zinc finger protein EZNF (1N119) [Caenorhabditis elegans] emb|CAB05558.1| Hypothetical pro
  Gene Ontology: Mol. function=transcription factor activity; Cellular component=nucleus; Biological process=regulation of transcription, DNA-dependent
  Coding regions on vcDNA: vcDNA=SeqID_97564; Strand=+; Position=2-568
SLLSPTHLLNETSLNLRCPYCPKKFLKNTEAISHMDPCLKSRPYPCTNCSRRFKSAQNLSQHERIHTNVRPYNCQYCEKNFTQKSHLQQHERIHTGEPAFSCRYCGETFNIYSSKIQHEKSICGLHEALDKQKENSSEKNGFAKIVRERSPIGSANSHLKKWPYDKVGTTSSTEQNDADRTIIVTGTSS

SEQ ID NO: 171142 - protein, 57 aa, Heterodera glycines; identical to SEQ ID NO: 167253
  Coding regions on vcDNA: vcDNA=SeqID_97565; Strand=-; Position=2-172

SEQ ID NO: 171143 - protein, 190 aa, Heterodera glycines
  Homolog annotation: Hit_ID=NP_506318.1; Match level="QueryCoverage =56%, HitCoverage=22%, E-value=3e-37, Identity=64%"; Hit description =cathepsin Z precursor (53.2 kD) (5N863) [Caenorhabditis elegans] emb|CAB03209.1| Hypothetical protein M04
  Gene Ontology: Mol. function=cysteine-type peptidase activity; Cellular component=extracellular space; Biological process =embryogenesis and morphogenesis
  Coding regions on vcDNA: vcDNA=SeqID_97566; Strand=+; Position=27-596
MENTGTADESADGPLGAFWEWHRMVAGADKFGSISQRMLHLRPSLKVPSVSKRIAFPSTAFPNPNPNNAIPPPNVVRRRAHNIPRDKPPCLRPMDRPFREHRTYPRSWEMPGFEATIPRQWDWRNVSGTNFCSPNRNQHIPVYCGGCWVFGTLGSLQDRFNVARKNRWPMTMLSPQEIIACNGRGSCNGG

SEQ ID NO: 171144 - protein, 45 aa, Heterodera glycines
  Coding regions on vcDNA: vcDNA=SeqID_97567; Strand=+; Position=2-139
KIAKIYKMPNFLILSCHYGTPTKCPSHEMSKRVKTHEMSKIFQNL

SEQ ID NO: 171145 - protein, 52 aa, Heterodera glycines
  Coding regions on vcDNA: vcDNA=SeqID_97568; Strand=-; Position=2-157
PQMVLLKVFSHFLMLFYHFLTRHSLLCHRLFRPQKLLRSFTAFGANPSGTIA

SEQ ID NO: 171146 - protein, 121 aa, Heterodera glycines
  Homolog annotation: Hit_ID=NP_741446.1; Match level="QueryCoverage =92%, HitCoverage=69%, E-value=2e-37, Identity=67%"; Hit description =serine/aRginine rich pre-mRNA SPlicing factor, Serpin (20.5 kD) (rsp- 6) [Caenorhabditis elegans] gb|AAA82
  Gene Ontology: Mol. function=pre-mRNA splicing factor activity; Cellular component=nuclear speck; Biological process=spliceosome assembly
  Coding regions on vcDNA: vcDNA=SeqID_97569; Strand=+; Position=41-406
MSSRRNEYLDAKIYVGGLPEDATSEELDDAFHRFGRIRKIWVARRPPGFAFVEFEDARDAEDAVLALDGTRICGVKARVELSHGNGRGGGRGFRGGGGRYDDRYGRDRYDRDRDRRYRSRY

SEQ ID NO: 171147 - protein, 115 aa, Heterodera glycines; identical to SEQ ID NO: 167230
  Homolog annotation: Hit_ID=NP_507780.1; Match level="QueryCoverage =99%, HitCoverage=7%, E-value=3e-10, Identity=33%"; Hit description =predicted CDS, DNA polymerase type B, organellar and viral family member (5T899) [Caenorhabditis elegans]
  Coding regions on vcDNA: vcDNA=SeqID_97570; Strand=+; Position=30-377

SEQ ID NO: 171148 - protein, 80 aa, Heterodera glycines
  misc_feature (64)..(64): Xaa can be any naturally occurring amino acid
  Homolog annotation: Hit_ID=AAQ12016.1; Match level="QueryCoverage =100%, HitCoverage=27%, E-value=2e-32, Identity=92%"; Hit description= tropomyosin [Heterodera glycines]
  Gene Ontology: Mol. function=structural constituent of cytoskeleton; Cellular component=muscle thin filament tropomyosin; Biological process=pole plasm oskar mRNA localization
  Coding regions on vcDNA: vcDNA=SeqID_97571; Strand=+; Position=63-300
MDAIKKKMQAMKIEKDNAIDRADAAEEKCRQTQERLERVEEELRDTQKKMMATENELDNAHEDXLTAANNLLEENENTVQ

SEQ ID NO: 171149 - protein, 167 aa, Heterodera glycines
  Coding regions on vcDNA: vcDNA=SeqID_97572; Strand=+; Position=110-610
MMERRLRSMAANDGTWEERPTNSSLANRPFFKLMEADMGNAQTEMPTSFVAKMSYQWLLPHLWLNDNKSKDKTKAEMDDAHTEMPTSFVAKMSYQWLLPHLWLNDNKSKDKTKAEMDDAHTEMPTSFVAKMSYQWLLPHLWLNDNKSKDKTKAEMDDAQTEMPTSFV

SEQ ID NO: 171150 - protein, 46 aa, Heterodera glycines
  Homolog annotation: Hit_ID=NP_649505.1; Match level="QueryCoverage =91%, HitCoverage=10%, E-value=1e-09, Identity=57%"; Hit description =CG31536-PC, isoform C [Drosophila melanogaster] gb|AAF52081.2| CG31536-PC, isoform C [Drosophila melanoga
  Coding regions on vcDNA: vcDNA=SeqID_97573; Strand=-; Position=2-139
AVLEQHRRLIGMEPAEADFVLLETARRCDFYGLRLHPARDIEGGGG

SEQ ID NO: 171151 - protein, 85 aa, Heterodera glycines
  Coding regions on vcDNA: vcDNA=SeqID_97574; Strand=-; Position=1-255
NLRSDFRARVWTPDTCEFLIFIHRFQFKFISLFSYHLLSYFYHDLVRVLDKILARDFVVIFLVTDFHGIRYFPGTKTHWISISLV

SEQ ID NO: 171152 - protein, 183 aa, Heterodera glycines
  Coding regions on vcDNA: vcDNA=SeqID_97575; Strand=+; Position=3-554
FGPLSAHYEEDDELLTPTKRLRELRLNSDEKCAMSDSIPRAVELFMEKKRARISKFLYTYNGNLQLNLPQLHAFACSTGGLIDDEFRERIWPILVKNLPQAKRCKDTQWDALRSEEYNDQTNHSSDELQQQQQTLFLSDSDFESAFSTFTPSISGCDDQLMDAEDDAEGDDAQRMAPQNATNR

SEQ ID NO: 171153 - protein, 161 aa, Heterodera glycines
  Coding regions on vcDNA: vcDNA=SeqID_97576; Strand=+; Position=65-547
FVILSTAPFRLLLLKISSNLLYNFFYFRMLNSCKFPKIILQVCGRGIQKLIWMLKLKHRVEHFGRRPNGKETPSRTFVRNCSLCSKRTCPREHLPLVPCFMQINATSCFIMAENLGFSMILDVSAFFFLIFVVAVWTCLFIFALTPFSELVSFLQFYYFIF

SEQ ID NO: 171154 - protein, 75 aa, Heterodera glycines; identical to SEQ ID NO: 142045
  Coding regions on vcDNA: vcDNA=SeqID_97577; Strand=-; Position=4-231

SEQ ID NO: 171155 - protein, 102 aa, Heterodera glycines
  misc_feature (32)..(32): Xaa can be any naturally occurring amino acid
  Homolog annotation: Hit_ID=NP_871812.1; Match level="QueryCoverage =99%, HitCoverage=12%, E-value=1e-20, Identity=50%"; Hit description =HAlF transporter, PGP related (haf-4) [Caenorhabditis elegans]
  Gene Ontology: Mol. function=TAP2 binding; Cellular component=TAP complex; Biological process=positive regulation of growth rate
  Coding regions on vcDNA: vcDNA=SeqID_97578; Strand=+; Position=2-310
LYQMKWAHNMPHLGQVWTGVMQSAGASRKAVXYNDRKPDIDTKGISSPDNLDGRIEFQNVHLDNCTLSDNPILLGPSFTVEPGKGEALLTATGRGNTPRIAR

SEQ ID NO: 171156 - protein, 208 aa, Heterodera glycines
  misc_feature (188)..(188): Xaa can be any naturally occurring amino acid
  Homolog annotation: Hit_ID=NP_727486.1; Match level="QueryCoverage =100%, HitCoverage=51%, E-value=2e-51, Identity=47%"; Hit description= CG2061-PC, isoform C [Drosophila melanogaster] ref|NP_727485.1| CG2061-PB, isoform B [Drosophila melanog
  Coding regions on vcDNA: vcDNA=SeqID_97579; Strand=+; Position=1-624
LNGRAGFLASLLELRLLFGQQLLSDDEIRSVLDAMVSSGRKYSKKHKSPAQLMFEWYNTEYLGAAHGVSGIYQMMLSFWDLLDASAKSDLKQSVDWLLSTQFSDGNFPSSSDRIGLSEELVHWCHGASGVLHLLIVASLVFKEDKYLESAERCVNLIWARGILRKGPGICHGVAGNGYAFLLLFRLTXNDKFLQMAHWFAFVMMAPSF

SEQ ID NO: 171157 - protein, 89 aa, Heterodera glycines; identical to SEQ ID NO: 167113
  misc_feature (48)..(48): Xaa can be any naturally occurring amino acid
  Homolog annotation: Hit_ID=CAE74349.1; Match level="QueryCoverage =78%, HitCoverage=28%, E-value=3e-13, Identity=44%"; Hit description =Hypothetical protein CBG22067 [Caenorhabditis briggsae]
  Coding regions on vcDNA: vcDNA=SeqID_97580; Strand=+; Position=1-271

SEQ ID NO: 171158 - protein, 116 aa, Heterodera glycines
  Homolog annotation: Hit_ID=CAE68714.1; Match level="QueryCoverage =66%, HitCoverage=23%, E-value=2e-10, Identity=39%"; Hit description =Hypothetical protein CBG14639 [Caenorhabditis briggsae]
  Coding regions on vcDNA: vcDNA=SeqID_97581; Strand=+; Position=2-352
IEPDVGCRLHLSGLNWEWHTLDTLRSHFGQFGTIEQLEMVAYPRGCGSLVFDSLNAAQLCLAAGEKHSVNGHSIEVKMVPAGFSPLFSPARPNSSDSALSAASSAPPPPNAPLNLL

SEQ ID NO: 171159 - protein, 51 aa, Heterodera glycines; identical to SEQ ID NO: 138508
  Coding regions on vcDNA: vcDNA=SeqID_97582; Strand=+; Position=2-157

SEQ ID NO: 171160 - protein, 116 aa, Heterodera glycines
  Homolog annotation: Hit_ID=AAH76997.1; Match level="QueryCoverage =87%, HitCoverage=33%, E-value=2e-27, Identity=50%"; Hit description =Palmitoyl-protein thioesterase 1 (ceroid-lipofuscinosis, neuronal 1, infantile) [Xenopus tropicalis] ref|N
  Gene Ontology: Mol. function=palmitoyl-protein hydrolase activity; Cellular component=extracellular space; Biological process =neurogenesis
  Coding regions on vcDNA: vcDNA=SeqID_97583; Strand=+; Position=34-384
MTFAFAVLLLLFIPPLTLAKNARAEGPVPVVLWHGMGDSCCNPYSMGFIRKLILTNMPHAYVLSLQLGSSVAEDIGRGYFANMNDEVAAVCQQLAEDARLANGYNAIGFSQGALFV

SEQ ID NO: 171161 - protein, 53 aa, Heterodera glycines; identical to SEQ ID NO: 162349
  Coding regions on vcDNA: vcDNA=SeqID_97584; Strand=+; Position=1-162

SEQ ID NO: 171162 - protein, 160 aa, Heterodera glycines
  Coding regions on vcDNA: vcDNA=SeqID_97585; Strand=+; Position=1-480
VMLNDTKLESTLSTTIKSIDLQIELPKCLDCLADGLNVTEEAITENGGGTIRFLRSSPPVSVPILPPYILLLHDQTNDANVWRKTLQILSASGFCCVAPHLSNFVFDEEENVNFLLNLTSHIGAREVVLVASSMSGIYLIPFLSRGIKKKDIHFHVKAFI

SEQ ID NO: 171163 - protein, 290 aa, Heterodera glycines
  Homolog annotation: Hit_ID=CAE62049.1; Match level="QueryCoverage =85%, HitCoverage=81%, E-value=2e-48, Identity=42%"; Hit description =Hypothetical protein CBG06065 [Caenorhabditis briggsae]
  Coding regions on vcDNA: vcDNA=SeqID_97586; Strand=+; Position=100-969
MDLAKAYGAPYDLVEQTLNKRRKMLRKTAKGTSRNIGPKNAKDAAYDHKMIRHKIFPMAAASYGDTENVKNCIRNTFRNATLYRNSVVQCNGKAYELCSAFTAVSHEDKAIILSFRGTDTGYQLIEETIQIALFKRSQSPDEEWGKVGSYFLKIFNQLVEEGKIIDYLAKLVNTYNNYELWVTGHSLGGAMAAIASATIVDAKLISAQRLKLVTFGQPRTGNGEWATAMDQKVGPFNYRVVNNRDLVPHMPPLWFEGYRHHMTEVFYNNAKNKTEEFVICADEAESEECA

SEQ ID NO: 171164 - protein, 106 aa, Heterodera glycines
  Homolog annotation: Hit_ID=NP_502336.1; Match level="QueryCoverage =78%, HitCoverage=70%, E-value=1e-10, Identity=39%"; Hit description =putative membrane protein (13.8 kD) (4N46) [Caenorhabditis elegans] gb|AAB97553.1| Hypothetical protein C
  Coding regions on vcDNA: vcDNA=SeqID_97587; Strand=+; Position=9-329
MMNSTLTLIFHRGPAPTVYAMFNNSVWTFMLVYGVTGRFISASVVSLLTMPATAALWVWEADRDYERWEGSRVLRERRVPKFVLPRTIFDWSDFDYAQQMRKAPTG

SEQ ID NO: 171165 - protein, 102 aa, Heterodera glycines
  misc_feature (44)..(45): Xaa can be any naturally occurring amino acid
  misc_feature (49)..(50): Xaa can be any naturally occurring amino acid
  Coding regions on vcDNA: vcDNA=SeqID_97588; Strand=-; Position=5-313
ENREKKFFFPRPNFSHFPIPCANGVITSSFCEIEMGPGYPTGQXXDSWXXNSSPWKVGPTTSRPLFFSGPHHQVIERAEESRGKVHTFEAVKMPILLKLQDR

SEQ ID NO: 171166 - protein, 135 aa, Heterodera glycines
  Coding regions on vcDNA: vcDNA=SeqID_97589; Strand=-; Position=2-406
YSLAFYPTNAVKKNKQKSAITQVVGSPPKFAPIRKSANASHSIRSTLPGYASPTEALAPIRTARPCSGPMQQRLDDRALHRAQCPLCYPSPPCKSSPRRALPMEQKRYFPAPMPSSFRWGVLLLRVAAGRDNEVF

SEQ ID NO: 171167 - protein, 158 aa, Heterodera glycines
  Homolog annotation: Hit_ID=XP_391955.1; Match level="QueryCoverage =80%, HitCoverage=19%, E-value=4e-46, Identity=66%"; Hit description =similar to ENSANGP00000010338 [Apis mellifera]
  Gene Ontology: Mol. function=zinc ion binding; Cellular component =cytoskeleton; Biological process=signal transduction
  Coding regions on vcDNA: vcDNA=SeqID_97590; Strand=+; Position=19-495
MLIRSRQQLCALFRSSIRLLKPRIGCYSVLAQMSTEVEKAQKAKPGGDTIFGKIIRKEMPSTILYEDDEVLAFKDINPEAPVHFLVIPKKCITALSNSEEQDQAVLGKLLLTANNVAKAQGLSNGYRIVINNGRHGCQSVYHLHLHVLGGRQLGWPPG

SEQ ID NO: 171168 - protein, 180 aa, Heterodera glycines
  Homolog annotation: Hit_ID=XP_422386.1; Match level="QueryCoverage =98%, HitCoverage=53%, E-value=7e-56, Identity=57%"; Hit description =PREDICTED: similar to DnaJ (Hsp40) homolog, subfamily B, member 4; DnaJ-like heat shock protein 40 [Gallu
  Gene Ontology: Mol. function=heat shock protein activity; Cellular component=nucleus; Biological process=response to heat
  Coding regions on vcDNA: vcDNA=SeqID_97591; Strand=+; Position=1-543
QDTAVTHELPISLEDLCKGCTKKMKITKKIVNPDGTSRTEDKVLTINVKPGWKSGTRITFPKEGDVFPNRMPADITFVIKDKPHPKFRRDGSDIRYKQVVPLRDALCGMSIKVPTLEGDIIPLNIKHVTKPGSTQRIHDRGIPNPKTGKRGDLVVEFDVRFPDSIAPAARELIANALPPN

SEQ ID NO: 171169 - protein, 142 aa, Heterodera glycines
  Homolog annotation: Hit_ID=CAE66821.1; Match level="QueryCoverage =88%, HitCoverage=30%, E-value=4e-39, Identity=62%"; Hit description =Hypothetical protein CBG12186 [Caenorhabditis briggsae]
  Gene Ontology: Mol. function=mannose-1-phosphate guanylyltransferase activity; Cellular component=cytoplasm; Biological process=protein modification
  Coding regions on vcDNA: vcDNA=SeqID_97592; Strand=+; Position=226-651
MTTITPQQKPILKAVILVGGAQKGTRFRPLSLQLPKPLFPVAGVPLIEHHISQLCEQLENLHEIFIVGFYPAEQFANFISDCEKKYRRVPIRYIQENCPLGTAGGLLQYKDILIDRKPPDALFVLNADACGEFPFLEMVELN

SEQ ID NO: 171170 - protein, 169 aa, Heterodera glycines
  Coding regions on vcDNA: vcDNA=SeqID_97593; Strand=+; Position=1-507
QLSNLFDSFTAFADNYAQVLRERWHLGECGEDILILIVQTPPQMQPTDGPQSSAHSQPNGPFPMLFLSLGPLITSRLHPDFAGHALRHILFDANAQLQHDARPLFKVLNEMLLRMDAEVFGALAPAEFSAGVGTAPSSFVSTPHARHRHSYADGPTVPSRSHIPPWAWA

SEQ ID NO: 171171 - protein, 71 aa, Heterodera glycines; identical to SEQ ID NO: 167185
  Homolog annotation: Hit_ID=AAV91445.1; Match level="QueryCoverage =100%, HitCoverage=100%, E-value=2e-10, Identity=51%"; Hit description=hypothetical protein 32 [Lonomia obliqua]
  Coding regions on vcDNA: vcDNA=SeqID_97594; Strand=+; Position=68-283

SEQ ID NO: 171172 - protein, 136 aa, Heterodera glycines
  Homolog annotation: Hit_ID=AAT07059.1; Match level="QueryCoverage =83%, HitCoverage=25%, E-value=5e-13, Identity=35%"; Hit description =cathepsin F-like cysteine proteinase [Brugia malayi]
  Gene Ontology: Mol. function=cysteine-type peptidase activity; Cellular component=extracellular space
  Coding regions on vcDNA: vcDNA=SeqID_97595; Strand=+; Position=2-409
KFVDFQKRFSKNYSTIEEKLTRFSIFVANFEQLEKIRREGEVYGITTFFDCSDEELKELIMPHEYFESVPFSWAKPIREFRPMDANFKRPSEFDWRKNGVVNRVKNQRRGCACWACATARLGQVTAPNSQRNTGSL

SEQ ID NO: 171173 - protein, 79 aa, Heterodera glycines; identical to SEQ ID NO: 126123
  Coding regions on vcDNA: vcDNA=SeqID_97596; Strand=+; Position=3-242

SEQ ID NO: 171174 - protein, 87 aa, Heterodera glycines
  Homolog annotation: Hit_ID=XP_308965.1; Match level="QueryCoverage =74%, HitCoverage=15%, E-value=1e-13, Identity=53%"; Hit description =ENSANGP00000020214 [Anopheles gambiae]
  Gene Ontology: Mol. function=isovaleryl-CoA dehydrogenase activity; Cellular component=mitochondrial matrix
  Coding regions on vcDNA: vcDNA=SeqID_97597; Strand=+; Position=3-263
QLVFRLAQRELAPLATQIDRHDQFTKLREFWRLLVQNGLLGITVPAEFGGSERNYFDHCIVMEVLLPIGPKSGGIFNSAHFCHKLNS

SEQ ID NO: 171175 - protein, 182 aa, Heterodera glycines
  Homolog annotation: Hit_ID=CAE59703.1; Match level="QueryCoverage =100%, HitCoverage=34%, E-value=3e-72, Identity=69%"; Hit description= Hypothetical protein CBG03134 [Caenorhabditis briggsae]
  Gene Ontology: Mol. function=methylmalonate-semialdehyde dehydrogenase (acylating) activity; Cellular component =mitochondrion; Biological process=pyrimidine nucleotide metabolism
  Coding regions on vcDNA: vcDNA=SeqID_97598; Strand=+; Position=3-551
DIGPVISQKAKERICELVESALEEGADVPLDGTNVTVKGFEKGNFVGPTVITGVKPEMLCYKEEIFGPVLCVLETETLDEAMDLINKNPYGNGTALFTRSGIAAHRFVSEIDVGQVGINVPIPVPLPMFSFTGSRGSFLGDANFYGKAGLNFYTQIRTVTQLWRSEDASTEAKPQLSFPQFK

SEQ ID NO: 171176 - protein, 87 aa, Heterodera glycines
  Coding regions on vcDNA: vcDNA=SeqID_97599; Strand=-; Position=69-332
LALILSSIAFRTMLRYLSKSLSSTRSALVDISSVHFSFYHPSKTSSPTGSLLLSEGEHSTASGSLVNVRMPNIKGEADGAVDHDQCM

SEQ ID NO: 171177 - protein, 159 aa, Heterodera glycines
  Coding regions on vcDNA: vcDNA=SeqID_97600; Strand=+; Position=2-478
MMMNSDNSSAINSKSFDQISEIGSMATDGLLQDDGVPDYAKIIIKQQQALIATLMNMQQQQQESRYASTISLFQQHQPHFLSNNDSSFPPPGIPTHPSPPPGIRPPVSPAPVSAPPPPPPGFRAPPGFNVSVSSRKFELDSTKSDTGGSHKFDIREELK

SEQ ID NO: 171178 - protein, 99 aa, Heterodera glycines; identical to SEQ ID NO: 167175
  Coding regions on vcDNA: vcDNA=SeqID_97601; Strand=-; Position=3-299

SEQ ID NO: 171179 - protein, 68 aa, Heterodera glycines; identical to SEQ ID NO: 167170
  Coding regions on vcDNA: vcDNA=SeqID_97602; Strand=-; Position=2-205

SEQ ID NO: 171180 - protein, 98 aa, Heterodera glycines
  misc_feature (1)..(1): Xaa can be any naturally occurring amino acid
  Coding regions on vcDNA: vcDNA=SeqID_97603; Strand=-; Position=65-361
XSFAFNSEIIIKTVTGQIDVKKVVSHFTVSSQSALNAVSDVFRKAPESDVPVLVKPLVRHRFLPETVAGLDDSNRETQKNDGDGQCEQMSAAGGHPFP

SEQ ID NO: 171181 - protein, 159 aa, Heterodera glycines
  Coding regions on vcDNA: vcDNA=SeqID_97604; Strand=+; Position=3-479
KFEHIFKISFQLFVPMTFFKEVDYLSLRLDDPVSALADYLPNSIIYTINYSLALPPNLVLLYMGLRPSLITSRVKFPTLGMTCANLFGLFGFLLLNIVYLYTVFSDVRLSLFMCSLLRTVFYNTTYVCYFLFPVLAVDQYLYVCQNVELSIRSLKAVIG

SEQ ID NO: 171182 - protein, 189 aa, Heterodera glycines
  misc_feature (127)..(127): Xaa can be any naturally occurring amino acid
  Homolog annotation: Hit_ID=NP_477448.1; Match level="QueryCoverage =100%, HitCoverage=27%, E-value=5e-42, Identity=47%"; Hit description= CG6521-PA [Drosophila melanogaster] gb|AAF53027.1| CG6521-PA [Drosophila melanogaster] gb|AAO74697.1| LD
  Gene Ontology: Mol. function=SH3/SH2 adaptor protein activity; Biological process=synaptic vesicle endocytosis
  Coding regions on vcDNA: vcDNA=SeqID_97605; Strand=+; Position=48-614
MPIFGDPSSPYDEAVEKATAETMTNENWTLMFDICDRVASEGPRACKQCLLSVRKRLNHRDPHVVLLVLSLLDCLWNNCGTHFRREVSSKDFVGELNYKCTNSNRVVAERARSLVKKWAENECSKDXSLSLVESLYRDLRDQGLSFELDSTTNNHCQKKKAIVSNDPNVVSSEQEEADIAKAIALSLQE

SEQ ID NO: 171183 - protein, 135 aa, Heterodera glycines
  Homolog annotation: Hit_ID=G89050; Match level="QueryCoverage=77%, HitCoverage=89%, E-value=8e-39, Identity=68%"; Hit description =protein T05C3.1 [imported] - Caenorhabditis elegans
  Gene Ontology: Mol. function=RNA polymerase II transcription factor activity; Cellular component=nucleus; Biological process=blood coagulation
  Coding regions on vcDNA: vcDNA=SeqID_97606; Strand=+; Position=108-512
MSSISPANPKKFSIPSETNCVVCVDIATGNHYSVASCNGCKTFFRRAIVNNRSFICMGNGNCPIDKGVRCACRACRLEKCLQVGMDPNAIQSERDRIGYTKRTRREKLVGFDEGIGHERGDLCAESFASNDADLE

SEQ ID NO: 171184 - protein, 111 aa, Heterodera glycines
  misc_feature (74)..(74): Xaa can be any naturally occurring amino acid
  Homolog annotation: Hit_ID=NP_499054.1; Match level="QueryCoverage =94%, HitCoverage=74%, E-value=9e-20, Identity=49%"; Hit description =esophageal gland cell secretory protein 11 like precursor family member (3K419) [Caenorhabditis elegans]
  Coding regions on vcDNA: vcDNA=SeqID_97607; Strand=+; Position=12-345
MFLKFLILAFCFQLAMANLFGQKQSVAVVGMLKCKGKPSAGTKVKLYDNDHFTTDDLMAQSKTDNYGRFKLSGXFKEITKIDPKLNLYHDCNGDFPFTPCKWKITIKALDG

SEQ ID NO: 171185 - protein, 199 aa, Heterodera glycines
  Homolog annotation: Hit_ID=NP_496330.1; Match level="QueryCoverage =90%, HitCoverage=49%, E-value=3e-39, Identity=47%"; Hit description =peroxisomal isomerase (42.1 kD) (2L111) [Caenorhabditis elegans] emb|CAA86779.1| Hypothetical protein R06
  Coding regions on vcDNA: vcDNA=SeqID_97608; Strand=+; Position=1-597
NNLSSKFLKNGPFTKVALPFFSCFCFSTEAFEKAQKDMKQLKDEPDNDTKLELYALFKQANEGDVRGDRPKMLEFVARAKFDAWEKVKGMPKADAQHKYAEIVNSLLKNAGINNANTSETESDGIRRTKEGKVYKIELNRSDKYNAITWEMYEGLISALGDASADRETSVTVITGVGSYFWAGNGWGNLTRGGKTRDDL

SEQ ID NO: 171186 - protein, 75 aa, Heterodera glycines
  Coding regions on vcDNA: vcDNA=SeqID_97609; Strand=-; Position=3-227
TTTYPIYHSNYIFQSAFVGRAISQGNFAVRHAHQILRPIVQTLAETISERDVAFVATGGGGLIGIVGLVKGREKK

SEQ ID NO: 171187 - protein, 169 aa, Heterodera glycines
  Coding regions on vcDNA: vcDNA=SeqID_97610; Strand=+; Position=34-540
WIPRAAGFGTRLFDIFEHINTNEDVQFLRSSGNAGALAPQPLVPNTVYSLSDLCSAFSSAASLSAPPMGMASNSDAFGLRSTILPAAPLSAPPVGISTNSDDFGLRSTIVPAAPLSAPPMGISSNIDNTGATRERNHQYFFGHDFTTESFSSNSGTTRIRKPQPLNFSL

SEQ ID NO: 171188 - protein, 129 aa, Heterodera glycines; identical to SEQ ID NO: 163811
  Coding regions on vcDNA: vcDNA=SeqID_97611; Strand=+; Position=1-390

SEQ ID NO: 171189 - protein, 151 aa, Heterodera glycines
  Homolog annotation: Hit_ID=AAQ96373.1; Match level="QueryCoverage =100%, HitCoverage=40%, E-value=8e-56, Identity=69%"; Hit description= endophilin [Caenorhabditis elegans]
  Gene Ontology: Mol. function=protein binding; Cellular component =cytoplasm; Biological process=signal transduction
  Coding regions on vcDNA: vcDNA=SeqID_97612; Strand=+; Position=37-489
MSLSALKKQFNKANQYLNESIGTAEATKLDEEFTEMERKVDMTNELITQVIAGTNEYLQPNPAVRAKIAALGAMSKVRGSTKNQSYPQTEGMLADTMQKYGRSLGIQSDFGKALCDAADAFRQMADVKYQLEDNVKHNFLDPISDFQNNEL

SEQ ID NO: 171190 - protein, 74 aa, Heterodera glycines; identical to SEQ ID NO: 167139
  Coding regions on vcDNA: vcDNA=SeqID_97613; Strand=+; Position=3-227

SEQ ID NO: 171191 - protein, 144 aa, Heterodera glycines; identical to SEQ ID NO: 162267
  Homolog annotation: Hit_ID=NP_871961.1; Match level="QueryCoverage =93%, HitCoverage=95%, E-value=8e-40, Identity=60%"; Hit description =transthyretin-like precursor family member (15.5 kD) (2F18) [Caenorhabditis elegans] gb|AAO38659.1| Hypot
  Coding regions on vcDNA: vcDNA=SeqID_97614; Strand=+; Position=1-435

SEQ ID NO: 171192 - protein, 128 aa, Heterodera glycines
  misc_feature (14)..(14): Xaa can be any naturally occurring amino acid
  Homolog annotation: Hit_ID=NP_982285.1; Match level="QueryCoverage =85%, HitCoverage=29%, E-value=6e-39, Identity=66%"; Hit description =alcohol dehydrogenase 8b [Danio rerio] gb|AAP74382.1| mixed alcohol dehydrogenase Adh8b [Danio rerio] gb|
  Gene Ontology: Mol. function=alcohol dehydrogenase activity, zinc -dependent; Cellular component=cytoplasm; Biological process=retinoid metabolism
  Coding regions on vcDNA: vcDNA=SeqID_97615; Strand=+; Position=45-431
FQFISTKFEWIPLXKTIKCRAAVAWEPKKPLVIEQIEVAPPKEGEVRIKIMFTAICHTDVFQVSGINPNVKFPTIVGHEGAGVVESVGPGVESVRAGDHVIPMPLCQCRKCEECADPRTNLCQKFLYL

SEQ ID NO: 171193 - protein, 84 aa, Heterodera glycines; identical to SEQ ID NO: 167132
  Coding regions on vcDNA: vcDNA=SeqID_97616; Strand=-; Position=2-253

SEQ ID NO: 171194 - protein, 114 aa, Heterodera glycines
  Homolog annotation: Hit_ID=CAA52291.1; Match level="QueryCoverage =97%, HitCoverage=13%, E-value=4e-27, Identity=54%"; Hit description =Lon protease-like protein [Homo sapiens]
  Gene Ontology: Mol. function=ATP-dependent peptidase activity; Cellular component=mitochondrion; Biological process=proteolysis and peptidolysis
  Coding regions on vcDNA: vcDNA=SeqID_97617; Strand=+; Position=1-342
LFICTANVTDSPQRGLKDRMEMIEVAGYVAEEKLEIARKYLVPKCREKCALPDEKLVIKDDAIDSLIKSYCRESGVRFLFIAIEKICRKSAYQLVRGEGAGTQVLPIGVENSDH

SEQ ID NO: 171195 - protein, 102 aa, Heterodera glycines
  Homolog annotation: Hit_ID=AAH83453.1; Match level="QueryCoverage =89%, HitCoverage=27%, E-value=9e-12, Identity=37%"; Hit description =Zgc:103648 [Danio rerio] ref|NP_001005950.1| zgc:103648 [Danio rerio]
  Coding regions on vcDNA: vcDNA=SeqID_97618; Strand=+; Position=1-306
MLKVIGNKNQFEAFVSSTEGESKRSLFVHFSAPWASSCAQLDDLLMELQREYGQNAFDIAKVDAESLPEVSMAQKVCAVPSVIIFKGGKVAGRVEGFQPAEL

SEQ ID NO: 171196 - protein, 171 aa, Heterodera glycines; identical to SEQ ID NO: 162363
  Coding regions on vcDNA: vcDNA=SeqID_97619; Strand=+; Position=30-545

SEQ ID NO: 171197 - protein, 140 aa, Heterodera glycines; identical to SEQ ID NO: 167118
  Coding regions on vcDNA: vcDNA=SeqID_97620; Strand=+; Position=3-425

SEQ ID NO: 171198 - protein, 293 aa, Heterodera glycines
  Homolog annotation: Hit_ID=NP_871881.1; Match level="QueryCoverage =80%, HitCoverage=84%, E-value=3e-20, Identity=26%"; Hit description =putative protein of bilaterial origin (33.1 kD) (1I415) [Caenorhabditis elegans] emb|CAD56580.1| Hypothet
  Coding regions on vcDNA: vcDNA=SeqID_97621; Strand=+; Position=47-925
MSLLPISRCSSLFHAARSLACRRPPPLASCHCLLSVPSTAPFSSHLSSSSPVVLHSLTTPVTSTHWCHRRAFASQSTPSAPVPNSTNNTPAAAGGGGIGLYQRYEQWLQNYPALYKLHRLTVDGSKWCYSDLKTFFWLAYGLRKGRITLNDLNARELFIYIQAGSQLVKLSLLAALAVLPAGFPLIIISMLVSPKLVLTRHFWTDWQSQQFQMDDLRRNERKLFPRIVDALRQHNPSSAAALAALEQQLPLTVDQLVTLQKSANIVPASLDAYTQQHRFFLKRVHNLPFWTTD

SEQ ID NO: 171199 - protein, 56 aa, Heterodera glycines
  Coding regions on vcDNA: vcDNA=SeqID_97622; Strand=-; Position=2-169
NKFYPTKPKVNGPISRPKKTTNPKIESIPIISVSHFFFPPGAAAFCADLVTFPPPS

SEQ ID NO: 171200 - protein, 116 aa, Heterodera glycines
  Homolog annotation: Hit_ID=AAP68935.1; Match level="QueryCoverage =87%, HitCoverage=35%, E-value=3e-20, Identity=44%"; Hit description =Aquaporin or aquaglyceroporin related protein 8, isoform b [Caenorhabditis elegans]
  Coding regions on vcDNA: vcDNA=SeqID_97623; Strand=+; Position=3-350
QSFQAASVHFGPQFTWGLGLAFGVYISAQISGGHLNPAISLVQMANGSISLVRFALYIFAQLFAAFLGSAVAFLGHFENCMQIQTRNGNQEFSQLFATFPSPNLSIWGSVADQLIG

SEQ ID NO: 171201 - protein, 148 aa, Heterodera glycines
  Homolog annotation: Hit_ID=NP_505573.1; Match level="QueryCoverage =51%, HitCoverage=16%, E-value=8e-16, Identity=50%"; Hit description =ectonucleoside triphosphate diphosphohydrolase precursor (53.8 kD) (5K487) [Caenorhabditis elegans] emb|C
  Coding regions on vcDNA: vcDNA=SeqID_97624; Strand=+; Position=30-473
MRIWPSPFVPPSLPFALLLPFCFCVALLLRFGAGRDDAAVGELQHNRLHPPDTKEIQQCLSPDLEAEESTSGRFFAAVIDAGSTGTRLHLFEFSHELEQEPSAFKLEAEIYKEIKPGVSCFAKTPELAAENVRELLLTAKRQIPAELW

SEQ ID NO: 171202 - protein, 53 aa, Heterodera glycines
  Coding regions on vcDNA: vcDNA=SeqID_97625; Strand=+; Position=103-264
IMSSRRNEYLDAKVLGFSTIIFRKTVKIYVGGLPEDATSEEVFTHSNYASNVF

SEQ ID NO: 171203 - protein, 77 aa, Heterodera glycines
  Coding regions on vcDNA: vcDNA=SeqID_97626; Strand=+; Position=2-235
TIESDIIFDNLEEQMLFQHSSDFPFFQYPVESEIEKSSKFHSLRRDGRIFRPFRRVCLLSVDQFLQFASSVVRSFSV

SEQ ID NO: 171204 - protein, 62 aa, Heterodera glycines
  Coding regions on vcDNA: vcDNA=SeqID_97627; Strand=-; Position=2-187
ALGFVANKCAPLWGDWSFGACISSRITTVIQVRSQGQVNYSWCNEPYAVSLYGRLNLHMHGL

SEQ ID NO: 171205 - protein, 41 aa, Heterodera glycines
  Coding regions on vcDNA: vcDNA=SeqID_97628; Strand=+; Position=33-158
SAHFFSPENVLYKFLNLIFEETTKLYHCPIISYFAIGKSIF

SEQ ID NO: 171206 - protein, 163 aa, Heterodera glycines
  Homolog annotation: Hit_ID=NP_492457.1; Match level="QueryCoverage =99%, HitCoverage=19%, E-value=1e-77, Identity=85%"; Hit description =translation Elongation FacTor (94.8 kD) (eft-2) [Caenorhabditis elegans] emb|CAB02985.1| Hypothetical pro
  Gene Ontology: Mol. function=translation elongation factor activity; Biological process=protein biosynthesis
  Coding regions on vcDNA: vcDNA=SeqID_97629; Strand=+; Position=3-491
DVNPTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQIIPTARRVFYASVLTAKPRLLEPVYLVEIQCPEAAVGGIYGVLNRRRGVVFEESQIAGTPMFI

SEQ ID NO: 171207 - protein, 97 aa, Heterodera glycines
  Coding regions on vcDNA: vcDNA=SeqID_97630; Strand=+; Position=2-292
AAARGKADPDNDNNKPPPPKEKKQSNKPAPPEAERKTRRKKPTNVLAVPSAVEQEEGGAFLEMVDSLSTAVNSLSEASHSLSQASHSLSNSAAQEMH

SEQ ID NO: 171208 - protein, 98 aa, Heterodera glycines; identical to SEQ ID NO: 167095
  Homolog annotation: Hit_ID=AAR12009.1; Match level="QueryCoverage =86%, HitCoverage=25%, E-value=4e-28, Identity=64%"; Hit description =cathepsin B-like proteinase [Triatoma infestans]
  Gene Ontology: Mol. function=peroxidase activity; Cellular component =extracellular space; Biological process=embryogenesis and morphogenesis
  Coding regions on vcDNA: vcDNA=SeqID_97631; Strand=+; Position=1-297

SEQ ID NO: 171209 - protein, 119 aa, Heterodera glycines; identical to SEQ ID NO: 125262
  Coding regions on vcDNA: vcDNA=SeqID_97632; Strand=-; Position=13-372

SEQ ID NO: 171210 - protein, 36 aa, Heterodera glycines; identical to SEQ ID NO: 167080
  Coding regions on vcDNA: vcDNA=SeqID_97633; Strand=-; Position=2-109

SEQ ID NO: 171211 - protein, 66 aa, Heterodera glycines; identical to SEQ ID NO: 155643
  Coding regions on vcDNA: vcDNA=SeqID_97634; Strand=-; Position=0-197

SEQ ID NO: 171212 - protein, 39 aa, Heterodera glycines; identical to SEQ ID NO: 167077
  Coding regions on vcDNA: vcDNA=SeqID_97635; Strand=-; Position=8-127

SEQ ID NO: 171213 - protein, 206 aa, Heterodera glycines; identical to SEQ ID NO: 163784
  Homolog annotation: Hit_ID=AAC06296.1; Match level="QueryCoverage =65%, HitCoverage=62%, E-value=5e-58, Identity=83%"; Hit description =GTP-cyclohydrolase [Ostertagia ostertagi] sp|O61573|GCH1_OSTOS GTP cyclohydrolase I (GTP-CH-I)
  Gene Ontology: Mol. function=GTP cyclohydrolase I activity; Cellular component=cytoplasm; Biological process=neurotransmitter metabolism
  Coding regions on vcDNA: vcDNA=SeqID_97636; Strand=+; Position=21-638

SEQ ID NO: 171214 - protein, 39 aa, Heterodera glycines
  Coding regions on vcDNA: vcDNA=SeqID_97637; Strand=-; Position=57-176
FYRFLNVWIFWLTKTSSNLALSILIQIAPNFFYSLTRPY

SEQ ID NO: 171215 - protein, 84 aa, Heterodera glycines; identical to SEQ ID NO: 167070
  Coding regions on vcDNA: vcDNA=SeqID_97638; Strand=-; Position=3-254

SEQ ID NO: 171216 - protein, 79 aa, Heterodera glycines
  Coding regions on vcDNA: vcDNA=SeqID_97639; Strand=+; Position=3-242
RYGLAEDANFSRQALILSQKVPISASNKNLEPRQRSLSDYWLTNSIARASPTMAQCVKASRDYAVQPHTDPLRLANPHA

SEQ ID NO: 171217 - protein, 62 aa, Heterodera glycines; identical to SEQ ID NO: 167065
  Coding regions on vcDNA: vcDNA=SeqID_97640; Strand=+; Position=84-272

SEQ ID NO: 171218 - protein, 165 aa, Heterodera glycines
  Homolog annotation: Hit_ID=NP_506415.1; Match level="QueryCoverage =86%, HitCoverage=14%, E-value=3e-15, Identity=38%"; Hit description =putative protein, with a coiled coil domain (98.1 kD) (5O275) [Caenorhabditis elegans] emb|CAB02122.1| Hy
  Coding regions on vcDNA: vcDNA=SeqID_97641; Strand=+; Position=93-587
MRGTHNQSTKGQPKASAAKAVVQQQSPEMVAWLRRKEYDPRKAAADQSQREAQQRQQQNSFMACRFFSTSANAKTPFARWRQNRKSQQTMADQRSNRSHDDLSRLGESMDDESLHGVAVDPCSNSLQRTVDELTQKCHKSIELLKLCNQSGLSSSVEQLLEKVVE

SEQ ID NO: 171219 - protein, 41 aa, Heterodera glycines
  Coding regions on vcDNA: vcDNA=SeqID_97642; Strand=-; Position=37-162
IFKKAISEGLIIFQHNYYGISLFESVKVIICFFLIMLICCL

SEQ ID NO: 171220 - protein, 77 aa, Heterodera glycines
  Coding regions on vcDNA: vcDNA=SeqID_97643; Strand=+; Position=117-350
PSSTRPQIGTSFATFQCVGDKHFDGKSELTIWRTIEIRKDKGPEPKLSVQMDDKCVPFPLPDRPLPSKICFKWLRIE

SEQ ID NO: 171221 - protein, 185 aa, Heterodera glycines
  Homolog annotation: Hit_ID=EAK82881.1; Match level="QueryCoverage =100%, HitCoverage=58%, E-value=9e-41, Identity=47%"; Hit description= hypothetical protein UM05090.1 [Ustilago maydis 521] ref|XP_402705.1| hypothetical protein UM05090.1 [Ust
  Gene Ontology: Mol. function=hydrogen-transporting ATP synthase activity, rotational mechanism; Cellular component=proton -transporting ATP synthase, central stalk (sensu Eukarya); Biological process=ATP synthesis coupled proton transport
  Coding regions on vcDNA: vcDNA=SeqID_97644; Strand=+; Position=3-560
LRIGDPPGCMTSARGALVVLGDKCRNQLAREYRDAIKLTYSQLGKTVPSFLEASIIADEILAIKDLPANPKINVVYNKFLSVIAYEPTHMHTISYADLKAAPKLATYEMEGDILSNLHQFMFATSVHWAMNEGHAAEFAARRSAMDNATKNAGEMVDRLTLLYNRQRQASITNDLVDIITGASAL

SEQ ID NO: 171222 - protein, 66 aa, Heterodera glycines; identical to SEQ ID NO: 167054
  Coding regions on vcDNA: vcDNA=SeqID_97645; Strand=-; Position=3-200

SEQ ID NO: 171223 - protein, 159 aa, Heterodera glycines
  misc_feature (90)..(90): Xaa can be any naturally occurring amino acid
  Homolog annotation: Hit_ID=NP_497426.1; Match level="QueryCoverage =69%, HitCoverage=77%, E-value=3e-39, Identity=66%"; Hit description =predicted CDS, putative cytoplasmic protein (3C697) [Caenorhabditis elegans] gb|AAK84595.1| Hypothetical
  Coding regions on vcDNA: vcDNA=SeqID_97646; Strand=+; Position=3-479
SSSSPFPNCRCFLILFSVCCCCSLFCPFSNGENVYCTYYRDSNEITCGTVTCETHSPFTPDNSELDGLDTKLPRGWYRIGTLSIRHDRAXFNLYRRRATGLGYWDFYTQIPERNCIGQFGLHAGENIAGSVAVKDKRCFDRLVVQIERKSTTEKFDVLQ

SEQ ID NO: 171224 - protein, 97 aa, Heterodera glycines; identical to SEQ ID NO: 167047
  Coding regions on vcDNA: vcDNA=SeqID_97647; Strand=+; Position=26-319

SEQ ID NO: 171225 - protein, 91 aa, Heterodera glycines; identical to SEQ ID NO: 167045
  Homolog annotation: Hit_ID=CAE64058.1; Match level="QueryCoverage =100%, HitCoverage=26%, E-value=5e-31, Identity=68%"; Hit description= Hypothetical protein CBG08658 [Caenorhabditis briggsae]
  Gene Ontology: Mol. function=general RNA polymerase II transcription factor activity; Cellular component=transcription factor TFIIA complex; Biological process=regulation of protein activity, epigenetic
  Coding regions on vcDNA: vcDNA=SeqID_97648; Strand=+; Position=2-277

SEQ ID NO: 171226 - protein, 49 aa, Heterodera glycines
  Coding regions on vcDNA: vcDNA=SeqID_97649; Strand=-; Position=50-199
CSSRLSVQISHQSPFHRQIRRQIHRRRSHNAFAEVEHLKFNLKKEQKTF

SEQ ID NO: 171227 - protein, 76 aa, Heterodera glycines; identical to SEQ ID NO: 167043
  Coding regions on vcDNA: vcDNA=SeqID_97650; Strand=-; Position=82-312

SEQ ID NO: 171228 - protein, 75 aa, Heterodera glycines
  Coding regions on vcDNA: vcDNA=SeqID_97651; Strand=-; Position=83-310
EFYFFIIFRKYVAVPTAYAAFPYDLGGVLPREMVSRQYNLTQMTLFEDGGHFAAFECPKELGEDIIRFAQGLSLD

SEQ ID NO: 171229 - protein, 64 aa, Heterodera glycines; identical to SEQ ID NO: 139860
  Coding regions on vcDNA: vcDNA=SeqID_97652; Strand=+; Position=1-195

SEQ ID NO: 171230 - protein, 168 aa, Heterodera glycines
  Coding regions on vcDNA: vcDNA=SeqID_97653; Strand=+; Position=77-580
MAPAKFALSLCSSTNGIDRPHLCDWDAETSHYIRDNTRIWLCRRRITVAGGNTTVASKAQPVEILRERPTLLQPSDNENNVMNGIPEMLTANELTHEDSTNNASEIMAAQGNETTSIVVDKDPLKELKMMRRRLIQLTKRVSELETQNAQNANERTLLLGIVSASTLL

SEQ ID NO: 171231 - protein, 154 aa, Heterodera glycines
  Coding regions on vcDNA: vcDNA=SeqID_97654; Strand=+; Position=157-618
MLETPRTIPGFHSAGPRRLSLATSHYRQFGIVSSPLATSSPSPMLFSSAAAATLPDRLPLRRPKKPPQKLPLLMPQLHLQFPSSRTNTIRSTDLSSIYTVQPEEAALDERNAHLLQCIQMQQELINQATAAIALCHKKFRFSGTLQELSAQRLL

SEQ ID NO: 171232 - protein, 171 aa, Heterodera glycines
  Homolog annotation: Hit_ID=NP_871815.1; Match level="QueryCoverage =91%, HitCoverage=44%, E-value=1e-29, Identity=47%"; Hit description =DeHydrogenase, Short chain (dhs-2) [Caenorhabditis elegans] gb|AAO38639.1| Dehydrogenases, short chain pr
  Gene Ontology: Mol. function=steroid dehydrogenase activity; Cellular component=mitochondrion; Biological process=steroid metabolism
  Coding regions on vcDNA: vcDNA=SeqID_97655; Strand=+; Position=25-614
MGPAALLLLLPSLLLLFLLIRALLELIPVSRLDKRSVLITGCDSGFGFDLALRCLGAGMRVFAGCLTQTGIQSLKKSAQEKGIAVELLEPIELDVTSDESVAKALEFVERKLGPGKGLHALVNNAGISGNEANAESWDDWLIPKDYEDVFQVNTLGTIRVTHAFKRLVKRE

SEQ ID NO: 171233 - protein, 66 aa, Heterodera glycines
  Coding regions on vcDNA: vcDNA=SeqID_97656; Strand=-; Position=84-284
VHLILIKCFSKSCELNIHFLISFNNSRPSVILFGRDLSLNTQWPNWPDDVWSWPQVMPCHFVFDVM

SEQ ID NO: 171234 - protein, 184 aa, Heterodera glycines
  Homolog annotation: Hit_ID=EAL25953.1; Match level="QueryCoverage =96%, HitCoverage=39%, E-value=1e-28, Identity=42%"; Hit description =GA15579-PA [Drosophila pseudoobscura]
  Gene Ontology: Mol. function=(S)-2-hydroxy-acid oxidase activity; Cellular component=peroxisome; Biological process=fatty acid alpha -oxidation
  Coding regions on vcDNA: vcDNA=SeqID_97657; Strand=+; Position=26-577
MVNILADLVALGDVEKRALDFLPRAARGYYESGADDEQTLRENREAFRNFLIRPFALRDVSQLDPSVTVRLSPSTANPKCRPFARTFACPIGIAPSAFHRMAHDEGEIATVKAAGETGTLMICSTLSTVPLEKVAEAAPEGSTLWFQVANWHLEKQSATDSMNEYFQLYIYKDRTLTEKIVRRA

SEQ ID NO: 171235 - protein, 126 aa, Heterodera glycines
  misc_feature (38)..(38): Xaa can be any naturally occurring amino acid
  Coding regions on vcDNA: vcDNA=SeqID_97658; Strand=+; Position=3-380
TNKLFIMKRPSSVVAFGSHLFVGFILLSLFIGTLGTEXKETKPAAAHSPADAKHPPPVAAHAAAGRGHAFDPKPASPSPLGLLVLVPRLIRPMGGPPTGAEPKMGGGSRFKKYRRGPHKVFLGVVG

SEQ ID NO: 171236 - protein, 135 aa, Heterodera glycines
  Homolog annotation: Hit_ID=CAE66470.1; Match level="QueryCoverage =91%, HitCoverage=80%, E-value=3e-10, Identity=30%"; Hit description =Hypothetical protein CBG11749 [Caenorhabditis briggsae]
  Coding regions on vcDNA: vcDNA=SeqID_97659; Strand=+; Position=70-474
MAELITKLCTTKLAILKWLQMLCAVITVLFLIDGQRQSWFYTLVFVVSIVFGLISLLTLIANFFLHSRNQSVPLPAFEIGFNALAAFVCLAFAVLLTIDSVRMFGDDFSHHRFLPPANIGKDGWRNRTLVVAIVQ

SEQ ID NO: 171237 - protein, 96 aa, Heterodera glycines; identical to SEQ ID NO: 167004
  Homolog annotation: Hit_ID=CAE69711.1; Match level="QueryCoverage =81%, HitCoverage=65%, E-value=7e-14, Identity=53%"; Hit description =Hypothetical protein CBG15980 [Caenorhabditis briggsae]
  Gene Ontology: Biological process=anti-apoptosis
  Coding regions on vcDNA: vcDNA=SeqID_97660; Strand=-; Position=160-450

SEQ ID NO: 171238 - protein, 144 aa, Heterodera glycines
  Homolog annotation: Hit_ID=AAH87525.1; Match level="QueryCoverage =90%, HitCoverage=26%, E-value=3e-16, Identity=39%"; Hit description =Unknown (protein for IMAGE:7205760) [Xenopus laevis]
  Coding regions on vcDNA: vcDNA=SeqID_97661; Strand=+; Position=138-569
MSQHSGRFPVAVPPSPLHLARCELAAETVPIPKRCTLQIVLLRPCGSVVKLFMVAVNVLDMPSNSRTFIRQRVFSGDSAKGTGEKERSGNENKTGGSTNVPNAKPCSNSLRFLIHLRLASDSSGKVYLHSDIRILFSNKSKDLE

SEQ ID NO: 171239 - protein, 136 aa, Heterodera glycines
  Homolog annotation: Hit_ID=CAB88203.1; Match level="QueryCoverage =96%, HitCoverage=43%, E-value=2e-41, Identity=64%"; Hit description =putative cuticular collagen [Globodera pallida]
  Coding regions on vcDNA: vcDNA=SeqID_97662; Strand=+; Position=2-409
QETHIVLGIASVCSLLAIIATVVTLPSLYSEMSQMNSKVRDGVEAFRVNTDSGWTDWMEVQGVVNPPFKPPGNPFQSIFSWQRKWAGNCQGLGLPKPNCPFGPPGPSGTLGNPGNPGGRENPENLEKLGKPLFLGP

SEQ ID NO: 171240 - protein, 156 aa, Heterodera glycines
  Homolog annotation: Hit_ID=CAE68288.1; Match level="QueryCoverage =60%, HitCoverage=40%, E-value=1e-11, Identity=37%"; Hit description =Hypothetical protein CBG13973 [Caenorhabditis briggsae]
  Coding regions on vcDNA: vcDNA=SeqID_97663; Strand=+; Position=18-485
MYVERQFVRIVAVITMGGSSLRSIRRISSFYPSLSVNRPQRFSYVVQMSSDSNNVRHGVALLCWHCGGDSMTPSDDNAGTVLLCSRCGRLQPLPARIDFFSYFGLDDPAGATIGEAELKRRFRRMQSLVHPDKFAGRDENERALAEQHSAFLNNAY

SEQ ID NO: 171241 - protein, 88 aa, Heterodera glycines
  Coding regions on vcDNA: vcDNA=SeqID_97664; Strand=-; Position=1-264
LKVKEINDRTKGPIVGCPIIRVFTCCISIHPAYLSERAKKRKRDEKGFGGGSGEGEKARGRRGVREGGERVRGRGGEREGRRGKGGRA

SEQ ID NO: 171242 - protein, 52 aa, Heterodera glycines
  misc_feature (22)..(22): Xaa can be any naturally occurring amino acid
  misc_feature (24)..(24): Xaa can be any naturally occurring amino acid
  Coding regions on vcDNA: vcDNA=SeqID_97665; Strand=+; Position=97-252
INENFQTNFLQSGSTHFHIHRXPXVIPTLGNFDTDKGRSPGVRGISNEIWWV

SEQ ID NO: 171243 - protein, 66 aa, Heterodera glycines
  Coding regions on vcDNA: vcDNA=SeqID_97666; Strand=-; Position=355-555
LQIHWFKLHMRYISKFFDSVRRFDKDGFRFAISRSTFGNWSRIFSAITCNHHDCEVWPTKKKVIAF

SEQ ID NO: 171244 - protein, 183 aa, Heterodera glycines; identical to SEQ ID NO: 166979
  Coding regions on vcDNA: vcDNA=SeqID_97667; Strand=-; Position=2-550

SEQ ID NO: 171245 - protein, 207 aa, Heterodera glycines
  misc_feature (99)..(99): Xaa can be any naturally occurring amino acid
  Homolog annotation: Hit_ID=NP_871946.1; Match level="QueryCoverage =35%, HitCoverage=12%, E-value=3e-18, Identity=58%"; Hit description =3'5'-cyclic nucleotide phosphodiesterase family member (2H918) [Caenorhabditis elegans] gb|AAO38608.1| Hy
  Gene Ontology: Mol. function=cAMP-specific phosphodiesterase activity; Cellular component=insoluble fraction; Biological process =signal transduction
  Coding regions on vcDNA: vcDNA=SeqID_97668; Strand=+; Position=7-626
PTPSWRHCGWPVHSSRHLHGRPGRVSSSVPGPRTVAELPKSFLEQHHLTVAFKVLKVHRSAIHLAICSNPIKPIKLYWQWNERVMGVYWRQGNRKKRLXPEISQMCDRGNVTVEKSQLLFVLFVAFNLCLWLQHRLSMKSEQDGNRIINAEKWAVSIVRCVHWSVRAIILRLNASNSLVSNHLPNQSPMQWKKARSLSMWNRSRKKF

SEQ ID NO: 171246 - protein, 122 aa, Heterodera glycines
  Homolog annotation: Hit_ID=CAA65506.1; Match level="QueryCoverage =93%, HitCoverage=67%, E-value=7e-39, Identity=49%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Coding regions on vcDNA: vcDNA=SeqID_97669; Strand=+; Position=120-488
GEQRLRPASPGRPGPQGPPGPDGQPGNPGESGQPVLFGKLTQGPPVVGPPGPSGPPGQPGQPGENGQPGQPGNPGPQGYPGDGGSPGQPGNPGGSGEPGQPGAQGSSGQCYHCPPPRTAPGY

SEQ ID NO: 171247 - protein, 73 aa, Heterodera glycines
  Homolog annotation: Hit_ID=NP_507517.1; Match level="QueryCoverage =93%, HitCoverage=12%, E-value=2e-24, Identity=82%"; Hit description =fray / Ste20 kinase homologue (5S436) [Caenorhabditis elegans] emb|CAC14417.1| Hypothetical protein Y59A8
  Gene Ontology: Mol. function=ATP binding; Cellular component =cytoplasm; Biological process=response to oxidative stress
  Coding regions on vcDNA: vcDNA=SeqID_97670; Strand=+; Position=86-307
AKSSRIAHELVTAELIDGHDLVVVAANLQKLIDLAQKKAERRTITFALNSGVASNEIPDERSLTGFAQLSLLD

SEQ ID NO: 171248 - protein, 111 aa, Heterodera glycines
  Homolog annotation: Hit_ID=XP_317655.1; Match level="QueryCoverage =99%, HitCoverage=18%, E-value=1e-32, Identity=60%"; Hit description =ENSANGP00000018448 [Anopheles gambiae]
  Gene Ontology: Mol. function=diacylglycerol O-acyltransferase activity; Cellular component=mitochondrion; Biological process =regulation of nurse cell apoptosis
  Coding regions on vcDNA: vcDNA=SeqID_97671; Strand=+; Position=1-336
AEFPIPANKNGDCFSLPQSPQIYKQLLMCGSIDRYYQVAICYRDEDAKPDRQPEFTQLDLELSFTSQEMVLSLIEQMIVNSWPDEITPKPTIPFPRMSHREAMDKFGTDKP

SEQ ID NO: 171249 - protein, 192 aa, Heterodera glycines
  Homolog annotation: Hit_ID=BAA03376.1; Match level="QueryCoverage =80%, HitCoverage=45%, E-value=1e-36, Identity=53%"; Hit description =dbpA murine homologue [Mus musculus]
  Gene Ontology: Mol. function=transcription co-repressor activity; Cellular component=cytoplasm; Biological process=negative regulation of transcription from Pol II promoter
  Coding regions on vcDNA: vcDNA=SeqID_97672; Strand=+; Position=34-609
MESSDANNNINNSEGEAENTTKNGGEEGVEKKILSKGVSGVVKWFNVMNGYGFICRDDTNDDIFVHNSAITANNPSKIQRSLGDGEKVMFDIVDGAKGPEAANVTGPDGVPVQGSKYAADLSQRRRFAGPRRNYFFRGNRNRRPRHSEEAAGGEVPVGEKKEGAEENNRRNVAGSTSGGTENEGEQKKEQTQ

SEQ ID NO: 171250 - protein, 159 aa, Heterodera glycines
  Homolog annotation: Hit_ID=CAE59244.1; Match level="QueryCoverage =100%, HitCoverage=16%, E-value=1e-71, Identity=76%"; Hit description= Hypothetical protein CBG02570 [Caenorhabditis briggsae]
  Gene Ontology: Mol. function=electron transporter activity; Cellular component=mitochondrion; Biological process=glycine catabolism
  Coding regions on vcDNA: vcDNA=SeqID_97673; Strand=+; Position=3-479
QRKICLIPISAHGTNPATAHMSNFRVVPVESDKHGNINYKDLSAKCEKHGAELACAMITYPSTHGVFESNILDVCQKVHEFGGQIYLDGANFNAQVGLCRPGDYGSDVSHFNLHKTFCIPQGGGGPGMGPIGVKAHLAPFLPGHPIVPIKGNRSGAVAA

SEQ ID NO: 171251 - protein, 108 aa, Heterodera glycines
  Homolog annotation: Hit_ID=CAB40895.1; Match level="QueryCoverage =84%, HitCoverage=91%, E-value=4e-22, Identity=52%"; Hit description =heat shock protein 10 [Oryzias latipes] sp|Q9W6X3|CH10_ORYLA 10 kDa heat shock protein, mitochondrial (Hsp
  Gene Ontology: Mol. function=ATP binding; Cellular component =mitochondrion; Biological process=protein folding
  Coding regions on vcDNA: vcDNA=SeqID_97674; Strand=+; Position=12-335
MLGHFSKLSVRCYASATRFRPVFDRVLIERFLPEQKTKGGIMIPEKAQGKVLKGTVVAIGPGYRNDEGKTIPMQLQIVFRVLLPEYGGAKILVRHKEGGGVRGADVIG

SEQ ID NO: 171252 - protein, 114 aa, Heterodera glycines
  Homolog annotation: Hit_ID=NP_492417.1; Match level="QueryCoverage =88%, HitCoverage=3%, E-value=4e-22, Identity=46%"; Hit description =fatty acid synthase (1J552) [Caenorhabditis elegans] emb|CAB04244.1| Hypothetical protein F32H2.5 [Caenorh
  Gene Ontology: Cellular component=mitochondrion; Biological process =polar body extrusion after meiotic divisions
  Coding regions on vcDNA: vcDNA=SeqID_97675; Strand=+; Position=132-473
MCKKTKSEPCCKKQVVELRNDIATNGCIAGGIECCDLTAHTVQRRPQTTGQLFLEELYFVKHVDNNSLADSPREREILAEYRNLLYSIILNGLRQWSKSGVLAQITNGEQFEHA

SEQ ID NO: 171253 - protein, 98 aa, Heterodera glycines
  Coding regions on vcDNA: vcDNA=SeqID_97676; Strand=+; Position=234-527
PFTDNRIHLKHKGRLDHHHHCIGSILSLWTRTSVIVILVTSLPLSGYLLVVSCIHLYKSGSRYFASSGGTSTPASSLAGGSSTGDALIPMVVAGAQVL

SEQ ID NO: 171254 - protein, 175 aa, Heterodera glycines
  Coding regions on vcDNA: vcDNA=SeqID_97677; Strand=+; Position=1-525
AFKHNFQMTNEITPNTTFGDITSDRVFYRPTFVTGDQMDLSLAALALREGSKSPTESVCSFDLMSAVGEDGEQNIADELASNGTAGEVEEQQQHTKQNNKQNNEKKCFAILKVRPISVNSTAAHCPNLKFEFVSKNTADNGTTQQQQLSTAASSSSSSAAASSADEVPPIAPSVG

SEQ ID NO: 171255 - protein, 52 aa, Heterodera glycines
  Homolog annotation: Hit_ID=AAF76925.1; Match level="QueryCoverage =100%, HitCoverage=34%, E-value=3e-20, Identity=92%"; Hit description= hypothetical esophageal gland cell secretory protein 11 [Heterodera glycines]
  Coding regions on vcDNA: vcDNA=SeqID_97678; Strand=+; Position=3-158
KQSAGAEGKLTCAGEPLADVKVKLYDDDRGVDTDDLMGETRTDSEGFFFIGG

SEQ ID NO: 171256 - protein, 86 aa, Heterodera glycines
  misc_feature (77)..(77): Xaa can be any naturally occurring amino acid
  Homolog annotation: Hit_ID=CAB88203.1; Match level="QueryCoverage =100%, HitCoverage=28%, E-value=2e-36, Identity=87%"; Hit description= putative cuticular collagen [Globodera pallida]
  Coding regions on vcDNA: vcDNA=SeqID_97679; Strand=+; Position=15-271
MQETHIVLGIASVCSLLAIIATVVTLPSLYSEMSQMNSKVRDGVEAFRVNTDSAWTDLMDVQVVVTPPSKPRDNPFXPFFRAKRQL

SEQ ID NO: 171257 - protein, 44 aa, Heterodera glycines
  Coding regions on vcDNA: vcDNA=SeqID_97680; Strand=+; Position=118-249
NAFLKVLTEYPSLSFGSSVVKQFQKYLFPKNCLYLRRQSKKITK

SEQ ID NO: 171258 - protein, 68 aa, Heterodera glycines
  Homolog annotation: Hit_ID=AAS78778.1; Match level="QueryCoverage =95%, HitCoverage=42%, E-value=4e-15, Identity=60%"; Hit description =thioredoxin [Ascaris suum]
  Coding regions on vcDNA: vcDNA=SeqID_97681; Strand=+; Position=2-205
LYFSAHWCPPCRNFTPVLKKFYDELKKSPETAPFEIVFVTFDRSADDLSNLFRQSFFFWLGIPLGKAT

SEQ ID NO: 171259 - protein, 61 aa, Heterodera glycines
  Coding regions on vcDNA: vcDNA=SeqID_97682; Strand=+; Position=3-185
RSEMAAVDQHQQQLVERIKQLDTLSTTADEQFDNSLNVPIGDLCRLLLAALAGDELAAGEA

SEQ ID NO: 171260 - protein, 158 aa, Heterodera glycines
  Coding regions on vcDNA: vcDNA=SeqID_97683; Strand=+; Position=2-475
ANLWDSRADNCFYAARYHGNVSDQFHEKVKYWEIEDVQNVSDRRISKDCSGSFYGCQTHACIDAKGNPVFVFNLCASSAAASGENNTGHCSHPELEELCAMEGGKSKCAICENGMCNEANIELQNVMGLDINGTIGTAVGGEWHEKCQNGRDRRRHDG

SEQ ID NO: 171261 - protein, 174 aa, Heterodera glycines
  Homolog annotation: Hit_ID=XP_330983.1; Match level="QueryCoverage =91%, HitCoverage=29%, E-value=6e-65, Identity=80%"; Hit description =hypothetical protein [Neurospora crassa] gb|EAA30290.1| hypothetical protein [Neurospora crassa]
  Gene Ontology: Mol. function=chaperone activity; Cellular component =actin filament; Biological process=cell organization and biogenesis
  Coding regions on vcDNA: vcDNA=SeqID_97684; Strand=+; Position=2-523
YNSGSPGLQVSGTRSFSPVQIFNDEASEERAENARLSSFIGAIAVGDLVKSTLGPKGMDKILQSMSTGEIMVTNDGATILKSIWLDNPAAKVLVNLSKVQDDEVGDGTTSVCVFGSELLREAEKLVNQKIHPQVIIEGYRIASAAALKALEAAAVDNGSNPEKFRQDLINIAKT

SEQ ID NO: 171262 - protein, 159 aa, Heterodera glycines
  Homolog annotation: Hit_ID=NP_510032.1; Match level="QueryCoverage =99%, HitCoverage=56%, E-value=1e-43, Identity=56%"; Hit description =reductase (29.2 kD) (XM767) [Caenorhabditis elegans] emb|CAA91943.1| Hypothetical protein M153.1 [Caenorh
  Gene Ontology: Mol. function=pyrroline 5-carboxylate reductase activity; Biological process=proline biosynthesis
  Coding regions on vcDNA: vcDNA=SeqID_97685; Strand=+; Position=2-478
LINSGRYPAENLMASCPKTDESLLEQCKKLGIGTTSDNTRIARENDVIILAVKPMNISKVTSEIAPNFRREHLLISIALGITLRYIEQLLPSKSRVVRVMPNTPAVVGAGASAYSMGSACPDGDSKGGPELGCPRGYAARGADGALEPTQADLAGPGPG

SEQ ID NO: 171263 - protein, 69 aa, Heterodera glycines
  Coding regions on vcDNA: vcDNA=SeqID_97686; Strand=-; Position=2-208
TLLVQKIYISVPAMRHDTDDRQNANKNARIKKNSENGAASKCRTPRNRLTLILLLELFERFAACDHNRP

SEQ ID NO: 171264 - protein, 69 aa, Heterodera glycines; identical to SEQ ID NO: 163649
  Coding regions on vcDNA: vcDNA=SeqID_97687; Strand=-; Position=2-208

SEQ ID NO: 171265 - protein, 57 aa, Heterodera glycines
  misc_feature (43)..(43): Xaa can be any naturally occurring amino acid
  misc_feature (45)..(53): Xaa can be any naturally occurring amino acid
  misc_feature (55)..(56): Xaa can be any naturally occurring amino acid
  Coding regions on vcDNA: vcDNA=SeqID_97688; Strand=+; Position=87-257
ASLCLFTHLTIIQILFGFFPLSLFFFPFFFLFFFLFFPPPPPXPXXXXXXXXXLXXF

SEQ ID NO: 171266 - protein, 57 aa, Heterodera glycines
  Homolog annotation: Hit_ID=XP_392962.1; Match level="QueryCoverage =98%, HitCoverage=18%, E-value=1e-11, Identity=53%"; Hit description =similar to putative activated protein kinase C receptor [Apis mellifera]
  Coding regions on vcDNA: vcDNA=SeqID_97689; Strand=+; Position=2-172
GDPMKLEGSLRGHNGWVTQIATNPLYKNMLVSASRDNTIIVWMLDDSGSALPANRYH

SEQ ID NO: 171267 - protein, 204 aa, Heterodera glycines
  misc_feature (151)..(151): Xaa can be any naturally occurring amino acid
  misc_feature (185)..(185): Xaa can be any naturally occurring amino acid
  Homolog annotation: Hit_ID=NP_497276.2; Match level="QueryCoverage =98%, HitCoverage=67%, E-value=8e-37, Identity=45%"; Hit description =RNA-binding protein S1 serine-rich domain like (rnp-4) [Caenorhabditis elegans] gb|AAK21429.2| Rnp (rrm r
  Gene Ontology: Mol. function=RNA binding; Cellular component=nucleus; Biological process=RNA splicing
  Coding regions on vcDNA: vcDNA=SeqID_97690; Strand=+; Position=3-617
MVERRKESPKRRRRSSSSSSSGSSSSTGSSSSGSSSSSSTTASRSPSPKKQRAAARPSARDDRTTRRSPRRSRSPHRVQPKTEKSTVSSRRSPSPRRRRPSPPSRGPRRRSRSPRHERAAPSPPPVKRERTPEPPPRRLCVRNLSRNITKXHMEEIFALFGALKSCGVPMDRVHVHLPRGYGEGXYERGEEAEEAAEHKERRPE

SEQ ID NO: 171268 - protein, 168 aa, Heterodera glycines
  Homolog annotation: Hit_ID=XP_392469.1; Match level="QueryCoverage =94%, HitCoverage=32%, E-value=3e-27, Identity=43%"; Hit description =similar to CG5735-PB [Apis mellifera]
  Gene Ontology: Biological process=germ-cell development
  Coding regions on vcDNA: vcDNA=SeqID_97691; Strand=+; Position=39-542
MTTIAANGGGETFSRKVFVGGLPLDIAQQTELELSRAFRQFGELQIEWPTKRVNQGKTTLDGKPAGPGYAFIVFADPRSVGLLLSKCRREVTAPGEKTRRYFLTLSSRTVHNKPVQVRPWRHSDAVFTPRSGLPVNIRWTVFIGGLPRPTRAIDLCRVLMPPIRGGVC

SEQ ID NO: 171269 - protein, 83 aa, Heterodera glycines
  Coding regions on vcDNA: vcDNA=SeqID_97692; Strand=-; Position=118-369
KCYAFHANRSGLHFHCIGHFTVPITSIGFLTGCDFVRVVLLEEIGNFSFAHPVVVLLGQTLGQFFYHFLFCAKQIENTCLAFA

SEQ ID NO: 171270 - protein, 208 aa, Heterodera glycines
  Homolog annotation: Hit_ID=XP_417828.1; Match level="QueryCoverage =89%, HitCoverage=68%, E-value=2e-58, Identity=56%"; Hit description =PREDICTED: similar to Palmitoyl-protein thioesterase 1 precursor (Palmitoyl-protein hydrolase 1) [Gallus
  Gene Ontology: Mol. function=palmitoyl-protein hydrolase activity; Cellular component=extracellular space; Biological process =neurogenesis
  Coding regions on vcDNA: vcDNA=SeqID_97693; Strand=+; Position=20-643
MTFAFAVLLLLFIPPLTLAKNARAEGPVPVVLWHGMGDSCCNPYSMGFIRKLILTNMPHAYVLSLQLGSSVAEDIGRGYFANMNDEVAAVCQQLAEDARLANGYNAIGFSQGALFVRALAQRCPYPPIRNLISIGGPQQGIFGLPFCPGSFYICSFIRRLLDNGAYTEFAQHNLVQAQYWHDPNLAEGYCRANIFLAHGNCERSCHQP

SEQ ID NO: 171271 - protein, 210 aa, Heterodera glycines
  Homolog annotation: Hit_ID=CAA65018.1; Match level="QueryCoverage =90%, HitCoverage=50%, E-value=6e-51, Identity=52%"; Hit description =S-adenosylmethionine decarboxylase [Onchocerca volvulus] emb|CAA65017.1| S-adenosylmethionine decarboxylas
  Gene Ontology: Mol. function=adenosylmethionine decarboxylase activity; Biological process=spermidine biosynthesis
  Coding regions on vcDNA: vcDNA=SeqID_97694; Strand=+; Position=18-647
MVDCPQQNGHRQQLPLFNASEHFFEGAEKLFEIWFDNDQQKRENGHKSTLRTIPENELRQLLNTAGCHILQVLRTAEIDAYLLSESSMFISDRRLILKTCGQTRPLLVIGKLLELARKHCQMDTVTNVYYSRKNFFRPHLQPQLHATFDEEVDYLDGFFQGGSAFCMGPLKHDRWYLYTLTTPRAPLDCSDHTLELANDGIPVELLSAYS

SEQ ID NO: 171272 - protein, 107 aa, Heterodera glycines
  Homolog annotation: Hit_ID=NP_499391.1; Match level="QueryCoverage =67%, HitCoverage=61%, E-value=9e-17, Identity=61%"; Hit description =putative nuclear protein (3L943) [Caenorhabditis elegans] emb|CAA19507.1| Hypothetical protein Y39A1C.1 [
  Coding regions on vcDNA: vcDNA=SeqID_97695; Strand=-; Position=16-339
HLLDQFVAPALRLWMVIDLVSSVLLVMIVIKKCFVRIRIPRTKRQIELRAAKRRKRKALKESGGGDGGESQESEHNQYRWLGEWGAIWGKRKWAIGKVGNGGSGMRK

SEQ ID NO: 171273 - protein, 188 aa, Heterodera glycines
  Homolog annotation: Hit_ID=NP_497128.1; Match level="QueryCoverage =69%, HitCoverage=55%, E-value=3e-16, Identity=33%"; Hit description =calcium-dependent protein kinase precursor (26.9 kD) (3A636) [Caenorhabditis elegans] gb|AAC26922.1| Hypo
  Coding regions on vcDNA: vcDNA=SeqID_97696; Strand=+; Position=19-582
MKLFLLFSLFLIQFSSAIDNMEHLMPENDADSLISYLEFQRWHKAVMGAEPRESSILFGKNDKDADGMLTVAEFVPLAFELSRKPPERQTDKIFKKFDVNSDEQLDRQELLKGDSISEEIVDGLFQVADVNNDGRISFDEFSTVANTLESRLSKDEKSAGMAMSLLAQLDTDKDERINGTELFEYAHK

SEQ ID NO: 171274 - protein, 81 aa, Heterodera glycines; identical to SEQ ID NO: 166911
  Coding regions on vcDNA: vcDNA=SeqID_97697; Strand=+; Position=27-272

SEQ ID NO: 171275 - protein, 176 aa, Heterodera glycines
  misc_feature (167)..(167): Xaa can be any naturally occurring amino acid
  Coding regions on vcDNA: vcDNA=SeqID_97698; Strand=+; Position=25-552
TPCWPSTSRSRVFRWRTARENGTRICVSKRRKTEALGRVKQLRLRTKRINGRSARAARNDSRQMERDRILFQRQRFPTVASIHHQPATSSASGVLVPIPTTDGAAAVPGSAGGYQRRYSTHREQQLQQRNRRDSKFSRRLAVYTSPPEDSAAGAISLRPLNTTIISXSPRTGSSSD

SEQ ID NO: 171276 - protein, 124 aa, Heterodera glycines
  Homolog annotation: Hit_ID=YP_000808.1; Match level="QueryCoverage =100%, HitCoverage=86%, E-value=2e-14, Identity=38%"; Hit description= hypothetical protein LIC10831 [Leptospira interrogans serovar Copenhageni str. Fiocruz L1-130] gb|AAS694
  Gene Ontology: Mol. function=protein binding; Cellular component =basolateral plasma membrane; Biological process=neurogenesis
  Coding regions on vcDNA: vcDNA=SeqID_97699; Strand=+; Position=102-473
MHTVDLSQRFIDSLPSSFFLGEHATYKDHAAISLLNLAHNHFVTVPPLVAQFINLISLDISNNHLALLPKEISSLKNLRELSLRNNLLENLPKEFQRLQCLRELNISGNLLEHFPRELLQIKSL

SEQ ID NO: 171277 - protein, 109 aa, Heterodera glycines; identical to SEQ ID NO: 166890
  Coding regions on vcDNA: vcDNA=SeqID_97700; Strand=-; Position=1-327

SEQ ID NO: 171278 - protein, 136 aa, Heterodera glycines
  misc_feature (61)..(61): Xaa can be any naturally occurring amino acid
  misc_feature (105)..(105): Xaa can be any naturally occurring amino acid
  Homolog annotation: Hit_ID=NP_497227.1; Match level="QueryCoverage =80%, HitCoverage=61%, E-value=1e-28, Identity=53%"; Hit description =cysteine-rich hydrophobic protein similar to CHIC1 and CHIC2 (19.8 kD) (3B256) [Caenorhabditis elegans] g
  Coding regions on vcDNA: vcDNA=SeqID_97701; Strand=+; Position=66-473
MEVGIERMESDENLENLPKVDWTITPEPIVIRGVGHLTLFGLNSHFPTEFPSALIGKLAPXEFDDTLRRVNYVLHRNVSRNLRWLICGLLFCCCSFSISLWPAAXLNRRTISALRKTLDRGNPNRFPNPASQWQLA

SEQ ID NO: 171279 - protein, 94 aa, Heterodera glycines; identical to SEQ ID NO: 166888
  Homolog annotation: Hit_ID=CAE67518.1; Match level="QueryCoverage =89%, HitCoverage=38%, E-value=1e-28, Identity=66%"; Hit description =Hypothetical protein CBG13037 [Caenorhabditis briggsae]
  Coding regions on vcDNA: vcDNA=SeqID_97702; Strand=+; Position=78-362

SEQ ID NO: 171280 - protein, 100 aa, Heterodera glycines; identical to SEQ ID NO: 166887
  Homolog annotation: Hit_ID=NP_493463.1; Match level="QueryCoverage =97%, HitCoverage=13%, E-value=2e-09, Identity=33%"; Hit description =DNaJ domain (prokaryotic heat shock protein) (86.5 kD) (dnj-29) [Caenorhabditis elegans] emb|CAA21710.2|
  Coding regions on vcDNA: vcDNA=SeqID_97703; Strand=+; Position=3-305

SEQ ID NO: 171281 - protein, 71 aa, Heterodera glycines
  Homolog annotation: Hit_ID=NP_501850.1; Match level="QueryCoverage =98%, HitCoverage=29%, E-value=4e-09, Identity=45%"; Hit description =DeHydrogenase, Short chain (26.6 kD) (dhs-12) [Caenorhabditis elegans] emb|CAA93099.1| Hypothetical prote
  Coding regions on vcDNA: vcDNA=SeqID_97704; Strand=+; Position=144-356
AALHHFSKMMALDESDIVTVFIHPGWVKTEMGGANAMMSVSDSVAKIMARICALTKSDSGKLLYREKELLP

SEQ ID NO: 171282 - protein, 202 aa, Heterodera glycines
  misc_feature (175)..(175): Xaa can be any naturally occurring amino acid
  Homolog annotation: Hit_ID=NP_510032.1; Match level="QueryCoverage =97%, HitCoverage=70%, E-value=9e-64, Identity=60%"; Hit description =reductase (29.2 kD) (XM767) [Caenorhabditis elegans] emb|CAA91943.1| Hypothetical protein M153.1 [Caenorh
  Gene Ontology: Mol. function=pyrroline 5-carboxylate reductase activity; Biological process=proline biosynthesis
  Coding regions on vcDNA: vcDNA=SeqID_97705; Strand=+; Position=9-614
MLSETVKIGFIGAGKMAQALARGLINSGRYPAENLMASCPKTDESLLEQCKKLGIGTTSDNTRIARENDVIILAVKPMNIIKVTSEIAPNFRREHLLISIALGITLRYIEQLLPSKSRVVRVMPNTPAVVGAGASAYSMGSACRDGDSKGGQDLFSTAGYSVEVPQVRVEPTAEXAGAGPADGCSVIEAVADGRTSSGLAQE

SEQ ID NO: 171283 - protein, 55 aa, Heterodera glycines
  Coding regions on vcDNA: vcDNA=SeqID_97706; Strand=-; Position=0-164
WLNTLLLGCLGASRDLARLSWRFSRIQPGCPVAYPDQPGSSGDYPDQPVCPGNCP

SEQ ID NO: 171284 - protein, 66 aa, Heterodera glycines
  Coding regions on vcDNA: vcDNA=SeqID_97707; Strand=+; Position=1-198
LNQLSETRLHLKATKTRVTREDGSVIEEEKTENGEFVVIFERANGNGNPSGFKQSKRMQKGRGYVI

SEQ ID NO: 171285 - protein, 99 aa, Heterodera glycines
  Coding regions on vcDNA: vcDNA=SeqID_97708; Strand=+; Position=1-300
AEGFKNNTWCHKIFLARSKKKTLRVPSRNFFLYTGLNSLDHPEKCVHCQMDVALLLARSGASIEKKNRQNKTPIDLVDGKEHKLKLIKASESVKPTAGT

SEQ ID NO: 171286 - protein, 196 aa, Heterodera glycines
  misc_feature (140)..(140): Xaa can be any naturally occurring amino acid
  Homolog annotation: Hit_ID=NP_491127.1; Match level="QueryCoverage =91%, HitCoverage=62%, E-value=2e-31, Identity=41%"; Hit description =thioredoxin-like protein (31.1 kD) (1D801) [Caenorhabditis elegans] gb|AAF60759.1| Hypothetical protein Y
  Gene Ontology: Mol. function=thiol-disulfide exchange intermediate activity; Cellular component=cytoplasm; Biological process=signal transduction
  Coding regions on vcDNA: vcDNA=SeqID_97709; Strand=+; Position=3-590
DIFILKNACRKTTNGHAEFTKFLLNVGTAPCIVDFFATWCQPCSAIAPGFDELSNNYLNLKFVKVDVDKCEETKNTYGVSAMFSFIVLINGQRVDLLRGADKTALQNLAHKWSKNCPTQMVSPIPGQCELSPLFNKIQCXCLNEDDSNNLNNLLNGVGPLITDCDEQLLISGAVHQPGQGDSGLFNGPRRKGAEKL

SEQ ID NO: 171287 - protein, 54 aa, Heterodera glycines
  Coding regions on vcDNA: vcDNA=SeqID_97710; Strand=-; Position=1-162
HNFAFYLQFLFNGIKSLLSNHFIKMHQCLCQQILRGCCGSVWRRSQIIARIVSN

SEQ ID NO: 171288 - protein, 86 aa, Heterodera glycines
  Homolog annotation: Hit_ID=NP_501571.1; Match level="QueryCoverage =81%, HitCoverage=20%, E-value=3e-11, Identity=37%"; Hit description =galectin (4J798) [Caenorhabditis elegans] pir||T20191 hypothetical protein C53D6.7 - Caenorhabditis elega
  Coding regions on vcDNA: vcDNA=SeqID_97711; Strand=+; Position=1-258
KLFGYRRKKVTKKDSLTGRNNSFPVPYLSKLEGNQLQPGQSLIVRGIIISSDEFVINLTNGPRVELDDEVRTLDDRPPRLFFFMGQ

SEQ ID NO: 171289 - protein, 81 aa, Heterodera glycines
  misc_feature (79)..(79): Xaa can be any naturally occurring amino acid
  Coding regions on vcDNA: vcDNA=SeqID_97712; Strand=+; Position=3-248
KYFFKTYFYFILTIFSSMSTNRGRGRVSLPSGDHSQTSEYGGRGRGMYSFATRQGRVKHSSAWPVGRWKLSFCREEREXKR

SEQ ID NO: 171290 - protein, 126 aa, Heterodera glycines
  Homolog annotation: Hit_ID=NP_871881.1; Match level="QueryCoverage =92%, HitCoverage=39%, E-value=6e-18, Identity=34%"; Hit description =putative protein of bilaterial origin (33.1 kD) (1I415) [Caenorhabditis elegans] emb|CAD56580.1| Hypothet
  Coding regions on vcDNA: vcDNA=SeqID_97713; Strand=+; Position=2-379
TPAPNSTNNTPAAAGRGGIGLYHRYNQWLQNYPALYKLHRLTVDGSKWCYSDLKTFFWLAYGLRKGRITLNDLNARELFIYIQCAPEVVHITTIFILLAIPVSGELVTLLALVSPKLVLTQHFWTE

SEQ ID NO: 171291 - protein, 127 aa, Heterodera glycines
  Coding regions on vcDNA: vcDNA=SeqID_97714; Strand=+; Position=2-382
PRRSDHFAASVDKCSDHSVPSSALSRGVETNPSAVRPANSAAALFQLPAEYDNGQPKRIRQHRTNDHRRLGYFWRSGQLRRHSASFIVTRKRYALPEIRTKVPSFVHIISLICKYVYSFHRKKQVYF

SEQ ID NO: 171292 - protein, 50 aa, Heterodera glycines; identical to SEQ ID NO: 166847
  Coding regions on vcDNA: vcDNA=SeqID_97715; Strand=+; Position=2-154

SEQ ID NO: 171293 - protein, 158 aa, Heterodera glycines
  Coding regions on vcDNA: vcDNA=SeqID_97716; Strand=+; Position=9-485
ALKIFYWMELLPEFDMLLAICGSARQLAVIHLQQIHRAFKVAQQPTVSCTNIANIEQCHIAVVSNSEHHRDKRTITDDRILFKCRAAHRTGNGLNAGELLFTVSSEDRVELHIFGHADAAHLQQPQQHQQSVKSILKRKILIHAFRQLLFILSNLIFV

SEQ ID NO: 171294 - protein, 52 aa, Heterodera glycines; identical to SEQ ID NO: 166837
  Coding regions on vcDNA: vcDNA=SeqID_97717; Strand=+; Position=67-225

SEQ ID NO: 171295 - protein, 88 aa, Heterodera glycines; identical to SEQ ID NO: 162221
  Coding regions on vcDNA: vcDNA=SeqID_97718; Strand=-; Position=17-283

SEQ ID NO: 171296 - protein, 119 aa, Heterodera glycines
  Coding regions on vcDNA: vcDNA=SeqID_97719; Strand=+; Position=1-360
QYFAQERTDVQTKQIFLAICRSFVSPAVPLTVPLSEDRQGNIYVSWDVLSFDGIRRSFAGALAWQKSQFEAFLTIICLIASSTLSQAVLQTASELRRKLRLIDEFFADPFSYAQERQKR

SEQ ID NO: 171297 - protein, 78 aa, Heterodera glycines
  Coding regions on vcDNA: vcDNA=SeqID_97720; Strand=+; Position=3-239
SAGEMERENRRVRSTRLSQQRYREKGNEARNLLPQLYSRIAELERENNLLKDLLWRERDPNSFAVAQQQKMVEKKLRK

SEQ ID NO: 171298 - protein, 197 aa, Heterodera glycines; identical to SEQ ID NO: 166832
  Homolog annotation: Hit_ID=NP_502512.1; Match level="QueryCoverage =74%, HitCoverage=58%, E-value=5e-22, Identity=33%"; Hit description =putative protein (28.1 kD) (4N847) [Caenorhabditis elegans] emb|CAA94333.2| Hypothetical protein C39E9.8a
  Coding regions on vcDNA: vcDNA=SeqID_97721; Strand=+; Position=3-593

SEQ ID NO: 171299 - protein, 127 aa, Heterodera glycines
  Homolog annotation: Hit_ID=NP_509346.1; Match level="QueryCoverage =96%, HitCoverage=47%, E-value=5e-31, Identity=52%"; Hit description =predicted CDS, phosphoglycolate phosphatase (XI605) [Caenorhabditis elegans] gb|AAB04900.1| Hypothetical
  Coding regions on vcDNA: vcDNA=SeqID_97722; Strand=+; Position=1-384
HDLEGLFARLKELGIKIAICTADSRAGTTRVLKTLKVEQFVDLIVCGDDKGSVPKPQPDNALFICRQLGVDPKNAMVIGDTPADLGMGRSAKLGSIVGVLSGIGEHKELNEADHLVEHVGELLPLIG

SEQ ID NO: 171300 - protein, 194 aa, Heterodera glycines; identical to SEQ ID NO: 162312
  Coding regions on vcDNA: vcDNA=SeqID_97723; Strand=+; Position=3-584

SEQ ID NO: 171301 - protein, 86 aa, Heterodera glycines; identical to SEQ ID NO: 162235
  Coding regions on vcDNA: vcDNA=SeqID_97724; Strand=+; Position=3-263

SEQ ID NO: 171302 - protein, 140 aa, Heterodera glycines; identical to SEQ ID NO: 163832
  misc_feature (78)..(78): Xaa can be any naturally occurring amino acid
  Homolog annotation: Hit_ID=NP_648239.1; Match level="QueryCoverage =85%, HitCoverage=25%, E-value=1e-24, Identity=52%"; Hit description =CG6638-PA [Drosophila melanogaster] gb|AAF50398.1| CG6638-PA [Drosophila melanogaster] gb|AAL90378.1| RE6
  Gene Ontology: Mol. function=isovaleryl-CoA dehydrogenase activity; Cellular component=mitochondrial matrix
  Coding regions on vcDNA: vcDNA=SeqID_97725; Strand=+; Position=139-559

SEQ ID NO: 171303 - protein, 40 aa, Heterodera glycines; identical to SEQ ID NO: 166827
  Coding regions on vcDNA: vcDNA=SeqID_97726; Strand=+; Position=1-123

SEQ ID NO: 171304 - protein, 100 aa, Heterodera glycines
  Coding regions on vcDNA: vcDNA=SeqID_97727; Strand=-; Position=34-336
LFSQIFNQMACSVRLDHHILLPSHFFPKFPPHGPPPPIPPQYGEPYIPRLARRAAGSLSTLSSCAVISAEKAHKTTKRKAMIKRRGDILRAISARVLKGN

SEQ ID NO: 171305 - protein, 92 aa, Heterodera glycines
  misc_feature (27)..(27): Xaa can be any naturally occurring amino acid
  Homolog annotation: Hit_ID=NP_820997.1; Match level="QueryCoverage =95%, HitCoverage=27%, E-value=3e-25, Identity=57%"; Hit description =cystathionine beta-synthase, putative [Coxiella burnetii RSA 493] gb|AAO91511.1| cystathionine beta-synth
  Gene Ontology: Mol. function=cystathione beta-synthase activity; Cellular component=cytoplasm; Biological process=cysteine metabolism
  Coding regions on vcDNA: vcDNA=SeqID_97728; Strand=+; Position=75-352
KDFVPYTTDRNLVDEWIKTNDANAFLXSRRLISGEGLLCGGSSGANVWAAMEVAKRMGRGKRVVTILPDGIRNYMSKFIDDEWMRVKGFEGI

SEQ ID NO: 171306 - protein, 87 aa, Heterodera glycines; identical to SEQ ID NO: 163280
  Homolog annotation: Hit_ID=CAE75166.1; Match level="QueryCoverage =90%, HitCoverage=79%, E-value=1e-25, Identity=63%"; Hit description =Hypothetical protein CBG23103 [Caenorhabditis briggsae]
  Coding regions on vcDNA: vcDNA=SeqID_97729; Strand=+; Position=5-268
